US012442035B2

(12) United States Patent
Hung et al.

(10) Patent No.: US 12,442,035 B2
(45) Date of Patent: Oct. 14, 2025

(54) COMPOSITIONS AND METHODS FOR DETECTING ANTIBIOTIC RESPONSIVE MRNA EXPRESSION SIGNATURES AND USES THEREOF

(71) Applicants: THE BROAD INSTITUTE, INC., Cambridge, MA (US); THE GENERAL HOSPITAL CORPORATION, Boston, MA (US)

(72) Inventors: Deborah Hung, Cambridge, MA (US); Roby Bhattacharyya, Boston, MA (US); Jonathan Livny, Cambridge, MA (US); Peijun Ma, Cambridge, MA (US)

(73) Assignees: THE BROAD INSTITUTE, INC., Cambridge, MA (US); THE GENERAL HOSPITAL CORPORATION, Boston, MA (US)

( * ) Notice: Subject to any disclaimer, the term of this patent is extended or adjusted under 35 U.S.C. 154(b) by 1263 days.

(21) Appl. No.: 17/271,496

(22) PCT Filed: Aug. 26, 2019

(86) PCT No.: PCT/US2019/048114

§ 371 (c)(1),
(2) Date: Feb. 25, 2021

(87) PCT Pub. No.: WO2020/046801

PCT Pub. Date: Mar. 5, 2020

(65) Prior Publication Data

US 2021/0230675 A1 Jul. 29, 2021

Related U.S. Application Data

(60) Provisional application No. 62/834,786, filed on Apr. 16, 2019, provisional application No. 62/723,417, filed on Aug. 27, 2018.

(51) Int. Cl.

| | |
|---|---|
| ***C12Q 1/6816*** | (2018.01) |
| ***C12N 1/06*** | (2006.01) |
| ***C12N 1/20*** | (2006.01) |
| ***C12Q 1/6876*** | (2018.01) |
| ***C12Q 1/689*** | (2018.01) |

(52) U.S. Cl.

CPC ............. *C12Q 1/6816* (2013.01); *C12N 1/06* (2013.01); *C12N 1/20* (2013.01); *C12Q 1/6876* (2013.01); *C12Q 1/689* (2013.01)

(58) Field of Classification Search

CPC .... C12Q 1/6816; C12Q 1/6876; C12Q 1/689; C12N 1/06; C12N 1/20

See application file for complete search history.

(56) References Cited

U.S. PATENT DOCUMENTS

| | | | |
|---|---|---|---|
| 9,885,088 | B2 | 2/2018 | Hung et al. |
| 2010/0136534 | A1 | 6/2010 | Wang et al. |

FOREIGN PATENT DOCUMENTS

| | | | |
|---|---|---|---|
| EP | 3231874 | A1 | 10/2017 |
| WO | 2011094514 | A1 | 8/2011 |
| WO | 2018144918 | A1 | 8/2018 |

OTHER PUBLICATIONS

Codjoe et al. ("Carbapenem resistance: a review." Medical Sciences 6.1 (2017)).*

Klebsiella pneumoniae capsular polysaccharide biosynthesis gene cluster, type: KL106-1: Genbank Accession LT174576.1; Publication [online]. Jun. 13, 2013 [retrieved Dec. 17, 2019]. Retrieved from the internet: <https://www.ncbi.nlm.nih.gov/nucleotide/LT174576.1?report=genbank&log$=nuclalign&blast_rank=14&RID=ZJ5BK3RD016>; pp. 1-10.

Klebsiella pneumoniae strain KpMDU1 cpsC capsular synthesis gene cluster, complete sequence: Genbank Accession KR007677.1; Publication [online]. Jun. 8, 2015 [retrieved Dec. 17, 2017]. Retrieved from the internet: <https://www.ncbi.nlm.nih.gov/nucleotide/KR007677.1?report=genbank&log$=nuclalign&blast_rank=19&RID=ZJ5BK3RD016>, pp. 1-10.

International Search Report dated Jan. 9, 2020 for related Application No. PCT/US2019/048114.

International Search Report dated Mar. 11, 2021 for related Application No. PCT/US2019/048114.

Extended European Search Report in corresponding application No. 19853410.9 dated May 13, 2022.

* cited by examiner

*Primary Examiner* — Kimberly Chong

(74) *Attorney, Agent, or Firm* — Day Pitney LLP; Richard B. Emmons; Christopher R. Cowles

(57) ABSTRACT

The present disclosure relates to compositions, methods, and kits for rapid phenotypic detection of antibiotic resistance/susceptibility.

11 Claims, 30 Drawing Sheets

Specification includes a Sequence Listing.

COMPOSITIONS AND METHODS FOR DETECTING ANTIBIOTIC RESPONSIVE MRNA EXPRESSION SIGNATURES AND USES THEREOF

CROSS-REFERENCE TO RELATED APPLICATIONS

This application is a national stage application, filed under 35 U.S.C. § 371, of International Patent Application No. PCT/US19/48114, filed Aug. 26, 2019, entitled "Compositions and Methods for Detecting Antibiotic Responsive mRNA Expression Signatures and Uses Thereof" and published Mar. 5, 2020 as WO 2020/046801, which claims the benefit of priority under 35 U.S.C. § 119(e) to U.S. Provisional Application No: 62/723,417, filed on Aug. 27, 2018, entitled, "Compositions and Methods for Detecting Antibiotic Responsive mRNA Expression Signatures and Uses Thereof"; and to U.S. Provisional Application No: 62/834,786, filed on Apr. 16, 2019, entitled, "Compositions and Methods for Detecting Antibiotic Responsive mRNA Expression Signatures and Uses Thereof." The entire contents of each of these applications are hereby incorporated by reference herein.

STATEMENT REGARDING FEDERALLY SPONSORED RESEARCH

The invention was made with government support under Grant Nos. AI117043, AI119157, and HHSN272200900018C awarded by the National Institutes of Health. The government has certain rights in the invention.

FIELD OF THE DISCLOSURE

The present disclosure relates to compositions, methods, and kits for rapid phenotypic detection of antibiotic resistance/susceptibility.

SEQUENCE LISTING

The instant application contains a Sequence Listing which has been filed electronically in ASCII format and is hereby incorporated by reference in its entirety. Said ASCII copy, created on Aug. 19, 2019, is named 52199_534001WO_BI10397_SL.txt and is 800 kB in size.

BACKGROUND OF THE DISCLOSURE

Antimicrobial agents such as antibiotics have been used successfully for many decades treat patients who have infectious diseases related to microbial pathogens. Unfortunately, these antimicrobial agents have been broadly used for such a long period of time that many microbial pathogens have become resistant to the antibiotics that are designed to kill them, which greatly reduces the efficacy of the antimicrobial agents that are currently available. This creates a significant healthcare issue. For example, each year in the United States at least 2 million people become infected with antibiotic resistant bacteria, which results in the death of at least 23,000 people each year. Accordingly, there is an urgent need for compositions and methods that enable rapid and accurate detection of antibiotic resistance in microbial pathogens.

BRIEF SUMMARY OF THE DISCLOSURE

The current disclosure relates, at least in part, to compositions, methods, and kits for rapid phenotypic detection of antibiotic resistance. The techniques herein provide compositions and methods that provide rapid phenotypic detection of antibiotic resistance/susceptibility in microbial pathogens, and are faster than the prior art growth-based phenotypic assays that currently comprise the gold standard for such detection (e.g., antibiotic susceptibility testing (AST)). The techniques herein also provide compositions and methods that enable simultaneous detection of multiple resistance genes in the same assay. In this manner, the techniques herein enable more accurate determination of antibiotic resistance, as well as provide: 1) mechanistic explanations for key antibiotic resistant strains, 2) epidemiologic tracking of known resistance mechanisms, and 3) immediate identification of unknown or potentially novel resistance mechanisms (such as, e.g., discordant cases when a resistant organism does not display a known resistance phenotype). Currently, detection of antibiotic resistance genes typically requires separate PCR or sequencing assays, which require different assay infrastructure and often necessitate sending samples out to reference laboratories.

In one aspect, the disclosure provides a method that includes the following steps: obtaining a sample including one or more bacterial cells, wherein the sample is obtained from a patient or an environmental source; processing the sample to enrich the one or more bacterial cells; contacting the sample with one or more antibiotic compounds; lysing the sample to release messenger ribonucleic acid (mRNA) from the one or more bacterial cells; hybridizing the released mRNA to at least one set of two nucleic acid probes, wherein each nucleic acid probe includes a unique barcode or tag; detecting the hybridized nucleic acid probes; identifying one or more genetic resistance determinants; and determining the identity of the one or more bacterial cells and the antibiotic susceptibility of each of the identified one or more bacterial cells.

In embodiments, the at least one set of two nucleic acid probes includes one or more probes from Table 3 and one or more probes from Table 4.

In embodiments, the at least one set of two nucleic acid probes includes one or more probes from Table 5 and one or more probes from Table 6.

In some embodiments, the at least one set of two nucleic acid probes includes a first probe that possesses a sequence of SEQ ID NOs: 1877-2762 and a second probe that possesses a sequence of SEQ ID NOs: 2763-3648. Optionally, the first probe possesses a sequence of SED ID NO: (1877+n) and the second probe possesses a sequence of SEQ ID NO: (2763+n), where n=an integer ranging from 0 to 885 in value. Optionally, one or both probes further includes a tag sequence.

In embodiments, the at least one set of two nucleic acid probes binds to one or more Cre2 target sequences listed in Table 1.

In embodiments, the at least one set of two nucleic acid probes binds to one or more KpMero4 target sequences listed in Table 2.

In embodiments, the hybridizing may occur at a temperature between about 64° C. and about 69° C. The hybridizing may occur at a temperature between about 65° C. and about 67° C. The hybridizing may also occur at a temperature of about 65° C. or about 66° C. or about 67° C. The hybridizing may occur at a temperature of about 65.0° C., 65.1° C., 65.2° C., 65.3° C., 65.4° C., 65.5° C., 65.6° C., 65.7° C., 65.8° C., 65.9° C., 66.0° C., 66.1° C., 66.2° C., 66.3° C., 66.4° C., 66.5° C., 66.6° C., 66.7° C., 66.8° C., 66.9° C., 67.0° C., 67.1° C., 67.2° C., 67.3° C., 67.4° C., 67.5° C., 67.6° C., 67.7° C., 67.8° C., or 67.9° C.

In one aspect, the disclosure provides a composition comprising a set of nucleic acid probes corresponding to the probes listed in Table 3 and Table 4.

In one aspect, the disclosure provides a composition comprising a set of nucleic acid probes corresponding to the probes listed in Table 5 and Table 6.

In an aspect, the disclosure provides a composition that includes at least one set of two nucleic acid probes including a first probe that possesses a sequence of SEQ ID NOs: 1877-2762 and a second probe that possesses a sequence of SEQ ID NOs: 2763-3648. Optionally, the first probe possesses a sequence of SED ID NO: (1877+n) and the second probe possesses a sequence of SEQ ID NO: (2763+n), where n=an integer ranging from 0 to 885 in value. Optionally, one or both probes further includes a tag sequence.

In one aspect, the disclosure provides a method of treating a patient that includes the steps of: obtaining a sample including one or more bacterial cells, wherein the sample is obtained from a patient or an environmental source; processing the sample to enrich the one or more bacterial cells; contacting the sample with one or more antibiotic compounds;

lysing the sample to release messenger ribonucleic acid (mRNA) from the one or more bacterial cells; hybridizing the released mRNA to at least one set of two nucleic acid probes at 65-67° C., wherein each nucleic acid probe includes a unique barcode or tag; detecting the hybridized nucleic acid probes; identifying one or more genetic resistance determinants; determining the identity of the one or more bacterial cells and the antibiotic susceptibility of each of the identified one or more bacterial cells; and administering to the patient an appropriate antibiotic based on the determination of the identity and the antibiotic susceptibility of the one or more bacterial cells.

In embodiments, the processing includes subjecting the sample to centrifugation or differential centrifugation.

In embodiments, the one or more antibiotic compounds are at a clinical breakpoint concentration.

In embodiments, lysing occurs by a method selected from the group consisting of mechanical lysis, liquid homogenization lysis, sonication, freeze-thaw lysis, and manual grinding.

In embodiments, the at least one set of two nucleic acid probes includes one control set and one responsive set, 3-5 control sets and 3-5 responsive sets, or 8-10 control sets and 8-10 responsive sets.

In embodiments, the hybridizing may occur at a temperature between about 64° C. and about 69° C. The hybridizing may occur at a temperature between about 65° C. and about 67° C. The hybridizing may also occur at a temperature of about 65° C. or about 66° C. or about 67° C. The hybridizing may occur at a temperature of about 65.0° C., 65.1° C., 65.2° C., 65.3° C., 65.4° C., 65.5° C., 65.6° C., 65.7° C., 65.8° C., 65.9° C., 66.0° C., 66.1° C., 66.2° C., 66.3° C., 66.4° C., 66.5° C., 66.6° C., 66.7° C., 66.8° C., 66.9° C., 67.0° C., 67.1° C., 67.2° C., 67.3° C., 67.4° C., 67.5° C., 67.6° C., 67.7° C., 67.8° C., or 67.9° C.

In one aspect, the disclosure provides a kit, including a set of nucleic acid probes corresponding to the probes listed in Table 3 and Table 4.

In one aspect, the disclosure provides a kit, comprising a set of nucleic acid probes corresponding to the probes listed in Table 5 and Table 6.

Another aspect of the instant disclosure provides a kit, including at least one set of two nucleic acid probes including a first probe that possesses a sequence of SEQ ID NOs: 1877-2762 and a second probe that possesses a sequence of SEQ ID NOs: 2763-3648, and instructions for its use.

Definitions

Unless specifically stated or obvious from context, as used herein, the term "about" is understood as within a range of normal tolerance in the art, for example within 2 standard deviations of the mean. "About" can be understood as within 10%, 9%, 8%, 7%, 6%, 5%, 4%, 3%, 2%, 1%, 0.5%, 0.1%, 0.05%, or 0.01% of the stated value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). Unless otherwise clear from context, all numerical values provided herein are modified by the term "about."

The term "administration" refers to introducing a substance into a subject. In general, any route of administration applicable to antimicrobial agents (e.g., an antibiotic) may be utilized including, for example, parenteral (e.g., intravenous), oral, topical, subcutaneous, peritoneal, intra-arterial, inhalation, vaginal, rectal, nasal, introduction into the cerebrospinal fluid, or instillation into body compartments. In some embodiments, administration is oral. Additionally or alternatively, in some embodiments, administration is parenteral. In some embodiments, administration is intravenous.

By "agent" is meant any small compound (e.g., small molecule), antibody, nucleic acid molecule, or polypeptide, or fragments thereof or cellular therapeutics such as allogeneic transplantation and/or CART-cell therapy.

As herein, the term "algorithm" refers to any formula, model, mathematical equation, algorithmic, analytical or programmed process, or statistical technique or classification analysis that takes one or more inputs or parameters, whether continuous or categorical, and calculates an output value, index, index value or score. Examples of algorithms include but are not limited to ratios, sums, regression operators such as exponents or coefficients, biomarker value transformations and normalizations (including, without limitation, normalization schemes that are based on clinical parameters such as age, gender, ethnicity, etc.), rules and guidelines, statistical classification models, statistical weights, and neural networks trained on populations or datasets.

By "alteration" is meant a change (increase or decrease) in the expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels.

The transitional term "comprising," which is synonymous with "including," "containing," or "characterized by," is inclusive or open-ended and does not exclude additional, unrecited elements or method steps. By contrast, the transitional phrase "consisting of" excludes any element, step, or ingredient not specified in the claim. The transitional phrase "consisting essentially of" limits the scope of a claim to the specified materials or steps "and those that do not materially affect the basic and novel characteristic(s)" of the claimed disclosure.

By "control" or "reference" is meant a standard of comparison. In one aspect, as used herein, "changed as compared to a control" sample or subject is understood as having a level that is statistically different than a sample from a normal, untreated, or control sample. Control samples include, for example, cells in culture, one or more laboratory test animals, or one or more human subjects. Methods to select and test control samples are within the ability of those in the art. Determination of statistical significance is within the ability of those skilled in the art, e.g., the number of standard deviations from the mean that constitute a positive result.

"Detect" refers to identifying the presence, absence or amount of the analyte (e.g., rRNA, mRNA, and the like) to be detected.

By "detectable label" is meant a composition that when linked to a molecule of interest (e.g., a nucleic acid probe) renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens. As used herein, the term "gene" refers to a DNA sequence in a chromosome that codes for a product (either RNA or its translation product, a polypeptide). A gene contains a coding region and includes regions preceding and following the coding region (termed respectively "leader" and "trailer"). The coding region is comprised of a plurality of coding segments ("exons") and intervening sequences ("introns") between individual coding segments.

The disclosure provides a number of specific nucleic acid targets (e.g., mRNA transcripts) or sets of nucleic acid targets that are useful for the identifying microbial pathogens (e.g., bacteria) that are susceptible or resistant to treatment with specific antibiotics. In addition, the methods of the disclosure provide a facile means to identify therapies that are safe and efficacious for use in subjects that have acquired bacterial infections involving antibiotic resistant strains of bacteria. In addition, the methods of the disclosure provide a route for analyzing virtually any number of bacterial strains via antibiotic susceptibility testing (AST) to identify mRNA signature patterns indicative of antibiotic susceptibility or resistance, which may then be used to rapidly identify such traits in the clinic, and direct appropriate therapeutic intervention.

By "fragment" is meant a portion of a polypeptide or nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

"Infectious diseases," also known as communicable diseases or transmissible diseases, comprise clinically evident illness (i.e., characteristic medical signs and/or symptoms of disease) resulting from the infection, presence, and growth of pathogenic biological agents (e.g., bacteria) in a subject (Ryan and Ray (eds.) (2004). Sherris Medical Microbiology (4th ed.). McGraw Hill). A diagnosis of an infectious disease can confirmed by a physician through, e.g., diagnostic tests (e.g., blood tests), chart review, and a review of clinical history. In certain cases, infectious diseases may be asymptomatic for some or all of their course. Infectious pathogens can include viruses, bacteria, fungi, protozoa, multicellular parasites, and prions. One of skill in the art would recognize that transmission of a pathogen can occur through different routes, including without exception physical contact, contaminated food, body fluids, objects, airborne inhalation, and through vector organisms. Infectious diseases that are especially infective are sometimes referred to as contagious and can be transmitted by contact with an ill person or their secretions.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation.

By "isolated polynucleotide" is meant a nucleic acid (e.g., a DNA) that is free of the genes which, in the naturally-occurring genome of the organism from which the nucleic acid molecule of the disclosure is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By "marker" is meant any protein or polynucleotide having an alteration in expression level or activity that is associated with a disease or disorder (e.g., increased or decreased expression in a bacterial strain indicative of antibiotic susceptibility).

As used herein, the term "next-generation sequencing (NGS)" refers to a variety of high-throughput sequencing technologies that parallelize the sequencing process, producing thousands or millions of sequence reads at once. NGS parallelization of sequencing reactions can generate hundreds of megabases to gigabases of nucleotide sequence reads in a single instrument run. Unlike conventional sequencing techniques, such as Sanger sequencing, which typically report the average genotype of an aggregate collection of molecules, NGS technologies typically digitally tabulate the sequence of numerous individual DNA fragments (sequence reads discussed in detail below), such that low frequency variants (e.g., variants present at less than about 10%, 5% or 1% frequency in a heterogeneous population of nucleic acid molecules) can be detected. The term "massively parallel" can also be used to refer to the simultaneous generation of sequence information from many different template molecules by NGS. NGS sequencing platforms include, but are not limited to, the following: Massively Parallel Signature Sequencing (Lynx Therapeutics); 454 pyro-sequencing (454 Life Sciences/Roche Diagnostics); solid-phase, reversible dye-terminator sequencing (Solexa/Illumina); SOLID technology (Applied Biosystems); Ion semiconductor sequencing (ion Torrent); and DNA nanoball sequencing (Complete Genomics). Descriptions of certain NGS platforms can be found in the following: Shendure, et al., "Next-generation DNA sequencing," Nature, 2008, vol. 26, No. 10, 135-1 145; Mardis, "The impact of next-generation sequencing technology on genetics," Trends in Genetics, 2007, vol. 24, No. 3, pp. 133-141;

Su, et al., "Next-generation sequencing and its applications in molecular diagnostics" Expert Rev Mol Diagn, 2011, 11 (3): 333-43; and Zhang et al., "The impact of next-generation sequencing on genomics," J Genet Genomics, 201, 38 (3): 95-109.

Nucleic acid molecules useful in the methods of the disclosure include any nucleic acid molecule that encodes a polypeptide of the disclosure or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the disclosure include any nucleic acid molecule that encodes a polypeptide of the disclosure or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred: embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 μg/ml denatured salmon sperm DNA (ssDNA). In a most preferred embodiment, hybridization will occur at 42° C. in 250 mM NaCl, 25 mM trisodium citrate, 1% SDS, 50% formamide, and 200 μg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between e-3 and e-100 indicating a closely related sequence.

Unless specifically stated or obvious from context, as used herein, the term "or" is understood to be inclusive. Unless specifically stated or obvious from context, as used herein, the terms "a", "an", and "the" are understood to be singular or plural.

The term "probe" as used herein refers to an oligonucleotide that binds specifically to a target mRNA. A probe can be single stranded at the time of hybridization to a target.

By "reference" is meant a standard or control condition.

A "reference sequence" is a defined sequence used as a basis for sequence comparison. A reference sequence may be a subset of or the entirety of a specified sequence; for example, a segment of a full-length mRNA or cDNA or gene sequence, or the complete mRNA or cDNA or gene sequence. For nucleic acids, the length of the reference nucleic acid sequence will generally be at least about 25 nucleotides, about 50 nucleotides, about 60 nucleotides, about 75 nucleotides, about 100 nucleotides, or about 300 nucleotides, or any integer thereabout or therebetween.

As used herein, the term "subject" includes humans and mammals (e.g., mice, rats, pigs, cats, dogs, and horses). In many embodiments, subjects are mammals, particularly primates, especially humans. In some embodiments, subjects are livestock such as cattle, sheep, goats, cows, swine, and the like; poultry such as chickens, ducks, geese, turkeys, and the like; and domesticated animals particularly pets such as dogs and cats. In some embodiments (e.g., particularly in research contexts) subject mammals will be, for example, rodents (e.g., mice, rats, hamsters), rabbits, primates, or swine such as inbred pigs and the like.

As used herein, the terms "treatment," "treating," "treat" and the like, refer to obtaining a desired pharmacologic and/or physiologic effect (e.g., reduction or elimination of a bacterial infection). The effect can be prophylactic in terms of completely or partially preventing a disease or infection or symptom thereof and/or can be therapeutic in terms of a partial or complete cure for a disease or infection and/or adverse effect attributable to the disease or infection. "Treatment," as used herein, covers any treatment of a disease or condition or infection in a mammal, particularly in a human, and includes: (a) preventing the disease or infection from occurring in a subject which can be predisposed to the disease or infection but has not yet been diagnosed as having it; (b) inhibiting the disease or infection, e.g., arresting its development; and (c) relieving the disease or infection, e.g., reducing or eliminating a bacterial infection.

The phrase "pharmaceutically acceptable carrier" is art recognized and includes a pharmaceutically acceptable material, composition or vehicle, suitable for administering compounds of the present disclosure to mammals. The carriers include liquid or solid filler, diluent, excipient, solvent or encapsulating material, involved in carrying or transporting the subject agent from one organ, or portion of the body, to another organ, or portion of the body. Each carrier must be "acceptable" in the sense of being compatible with the other ingredients of the formulation and not injurious to the patient. Some examples of materials which can serve as pharmaceutically acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and other non-toxic compatible substances employed in pharmaceutical formulations.

The term "pharmaceutically acceptable salts, esters, amides, and prodrugs" as used herein refers to those carboxylate salts, amino acid addition salts, esters, amides, and prodrugs of the compounds of the present disclosure which are, within the scope of sound medical judgment, suitable for use in contact with the tissues of patients without undue toxicity, irritation, allergic response, and the like, commensurate with a reasonable benefit/risk ratio, and effective for their intended use, as well as the zwitterionic forms, where possible, of the compounds of the disclosure.

The term "salts" refers to the relatively non-toxic, inorganic and organic acid addition salts of compounds of the present disclosure. These salts can be prepared in situ during the final isolation and purification of the compounds or by separately reacting the purified compound in its free base form with a suitable organic or inorganic acid and isolating the salt thus formed. Representative salts include the hydrobromide, hydrochloride, sulfate, bisulfate, nitrate, acetate, oxalate, valerate, oleate, palmitate, stearate, laurate, borate, benzoate, lactate, phosphate, tosylate, citrate, maleate, fumarate, succinate, tartrate, naphthylate mesylate, glucoheptonate, lactobionate and laurylsulphonate salts, and the like. These may include cations based on the alkali and alkaline earth metals, such as sodium, lithium, potassium, calcium, magnesium, and the like, as well as non-toxic ammonium, tetramethylammonium, tetramethylammonium, methlyamine, dimethlyamine, trimethlyamine, triethlyamine, ethylamine, and the like. (See, for example, S. M. Barge et al., "Pharmaceutical Salts," J. Pharm. Sci., 1977, 66:1-19 which is incorporated herein by reference.).

Ranges can be expressed herein as from "about" one particular value and/or to "about" another particular value. When such a range is expressed, another aspect includes from the one particular value and/or to the other particular value. Similarly, when values are expressed as approximations, by use of the antecedent "about," it is understood that the particular value forms another aspect. It is further understood that the endpoints of each of the ranges are significant both in relation to the other endpoint, and independently of the other endpoint. It is also understood that there are a number of values disclosed herein, and that each value is also herein disclosed as "about" that particular value in addition to the value itself. It is also understood that throughout the application, data are provided in a number of different formats and that this data represent endpoints and starting points and ranges for any combination of the data points. For example, if a particular data point "10" and a particular data point "15" are disclosed, it is understood that greater than, greater than or equal to, less than, less than or equal to, and equal to 10 and 15 are considered disclosed as well as between 10 and 15. It is also understood that each unit between two particular units are also disclosed. For example, if 10 and 15 are disclosed, then 11, 12, 13, and 14 are also disclosed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 as well as all intervening decimal values between the aforementioned integers such as, for example, 1.1, 1.2, 1.3, 1.4, 1.5, 1.6, 1.7, 1.8, and 1.9. With respect to sub-ranges, "nested sub-ranges" that extend from either end point of the range are specifically contemplated. For example, a nested sub-range of an exemplary range of 1 to 50 may comprise 1 to 10, 1 to 20, 1 to 30, and 1 to 40 in one direction, or 50 to 40, 50 to 30, 50 to 20, and 50 to 10 in the other direction.

A "therapeutically effective amount" of an agent described herein is an amount sufficient to provide a therapeutic benefit in the treatment of a condition or to delay or minimize one or more symptoms associated with the condition (e.g., an amount sufficient to reduce or eliminate a bacterial infection). A therapeutically effective amount of an agent means an amount of therapeutic agent, alone or in combination with other therapies, which provides a therapeutic benefit in the treatment of the condition. The term "therapeutically effective amount" can encompass an amount that improves overall therapy, reduces or avoids symptoms, signs, or causes of the condition, and/or enhances the therapeutic efficacy of another therapeutic agent.

By "KpMero4_C_KPN_00050 nucleic acid molecule" is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding "N" residues, that is part of the KpMero4 probeset.

```
>KpMero4_C_KPN_00050
                                        (SEQ ID NO: 1)
ATGAAGAACTGGAAAACGCTGCTTCTCGGTATCGCCATGATCGCGAATA
CCAGTTTCGCTGCCCCCCAGGTGGTCGATAAAGTAGCGGCCGTCGTCAA
TAATGGCGTCGTGCTGGAAAGCGACGTCGATGGTTTGATGCAATCGGTT
AAGCTCAATGCNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNCAGA
AAGATCGTGCTTACCGCATGCTGATGAACCGCAAATTCTCTGAAGAAGC
GGCAACCTGGATGCAGGAACAGCGCGCCAGTGCGTATGTTAAAATTCTG
AGCAACTAAN
```

By "KpMero4_C_KPN_00098 nucleic acid molecule" is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding "N" residues, that is part of the KpMero4 probeset.

```
>KpMero4_C_KPN_00098
                                        (SEQ ID NO: 2)
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
```

-continued

```
NNNNNNNNNNNNNNNNNNNNNNNNNGTGAAATGCGTACAGCGCGCCATCG
ACCAGGCCGAACTGATGGCGGATTGCCAGATTTCATCAGTTTATTTGGC
ACTTTCGGGTAAACATATAAGCTGTCAGAATGAAATCGGGATGGTACCG
ATTTCGGAAGAAGAAGTGACGCAGGANNNNNNNNNNNNNNNNNNNNNNNN
NNNNNNNNNNNNNNNNNNNNNNNNNNNNNNNNNNNGTCCTGCACGTGATT
CCGCAGGAATATGCTATCGACTACCAGGAAGGGATTAAAAACCCGGTAG
GGCTGTCCGGCGTGCGTATGCAGGCGAAGGTGCATCTGATCACCTGCCA
TAACGATATGGCNNNNNNNNNNNNNNNNNNNGTGGAACGTTGTGGTCTGA
AAGTTGACCAACTTATTTTCGCCGGGTTAGCGGCCAGTTATTCGGTATT
AACAGAAGACGAACGTGAGCTGGGCGTCTGCGTTGTGGANNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNN
```

By "KpMero4_C_KPN_00100 nucleic acid molecule" is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding "N" residues, that is part of the KpMero4 probeset.

```
>KpMero4_C_KPN_00100
                                        (SEQ ID NO: 3)
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNGCGATTGATGCCAGCACCCAGCGCTATACGCTGAACTTCTCGGCCGA
TGCGTTCATGCGTCAGATTAGCCGTGCGCGTACCTTCGGTTTTATGCGC
```

-continued

```
GATATCGAATATCTGCAGTCCCGCGGCCTGTGCCTGGGCGGCAGCTTCG

ATTGTGCCATCGTTGTTGACGATTATCGCGTACTGAACGAAGACGGTCT

GCGCTTTGAAGACGAATTTGTTCGCCACAAAATGCTGGATGCGATCGGT

GACCTGTTTATGTGTGGTCACAACATTATCGGCGCATTCACGGCGTACA

AATCGGGTCACGCGTTGAACAACAAACTGCTGCAGGCGGTNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNN
```

By “KpMero4_C_KPN_01276 nucleic acid molecule” is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding “N” residues, that is part of the KpMero4 probeset.

```
>KpMero4_C_KPN_01276
                                                (SEQ ID NO: 4)
ATGCTGGAGTTGTTGTTTCTGCTTTTACCCGTTGCCGCCGCTTACGGCT

GGTACATGGGGCGCAGAAGTGCACAACAGTCCAAACAGGACGATGCGAG

CCGCCTGTCGCGAGATTACGTGGCGGGGGTTAACTTCCTGCTCAGCAAC

CAGCAGGATAAAGCCGTCGACCTGTTCCTTGATATGCTGAAAGAGGATA

CCGGTACCGTTGAGGCNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNN
```

By “KpMero4_C_KPN_02846 nucleic acid molecule” is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding “N” residues, that is part of the KpMero4 probeset.

```
>KpMero4_C_KPN_02846
                                                (SEQ ID NO: 5)
ATGAATACTGAAGCCACTCAAGATCATCAAGAAGCAAACACCACGGGCG

CGCGTCTGCGTCACGCCCGCGAACAACTCGGACTTAGCCAGCAAGCGGT

GGCCGAACGCTTATGCCTGAAGGTGTCCACGGTTCGTGATATTGAAGAC

GATAAGGCCCCCGCCGACCTCGCCTCCACCTTCCTGCGCGGNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNCCGGCGGCGTCGGCGC

AGGATCTGGTGATGAACTTTTCCGCCGACTGCTGGCTGGAAGTGAGCGA

TGCCACCGGTAAAAAACTGTTCAGCGGCCTGCAGCGTAAAGGCGGTAAN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNN
```

By “KpMero4_C_KPN_03317 nucleic acid molecule” is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding “N” residues, that is part of the KpMero4 probeset.

```
>KpMero4_C_KPN_03317
                                                (SEQ ID NO: 6)
NNNNNNNNNNNNNNNNNNNNNNNNNNNNNNNN--ATGGCCGGGGAACACG

TCATTTTGCTGGATGAGCAGGATCAGCCTGCCGGTATGCTGGAGAAGTA

TGCCGCCCATACGTTTGATACCCCTTTACATCTCGCGTTTTCCTGCTGG

CTGTTTAANNNNNNNNNNNNNNNNNNNNNNNNNNNNCGTTCGTTGGGCAA

AAAAGCCTGGCCCGGGGTATGGACCAACTCGGTCTGCGGACACCCCCAG

CAGGGCGAGACCTTCGAGCAGGCCGTCACGCGCCGCTGTCGCTTCGAAC

TCGGTGTGGAGATCTCNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNCGCGTGGTAAGCGAAGTGCAGCCTAACGACGATGAAGTCA

TGGACTATCAGTGGGTTGACCTGGCAACCATGTTAAGCGCGCTGGCCGC

CACGCCGTGGGCGTTCAGCCCGTGGATGGTGCTGGAAGCGGAAAATCGG

GACGCCCGCCAGGCGCTGACCGAN
```

By “KpMero4_C_KPN_03634 nucleic acid molecule” is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding “N” residues, that is part of the KpMero4 probeset.

```
>KpMero4_C_KPN_03634
                                                (SEQ ID NO: 7)
NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN
```

-continued

```
NNNNNNNNNNNAACGATACGGCAGACGACTCCCCGGCGAGCTATAACGCC
GCGGTGCGCCCGCGCGGCGCCCGCCGTGGTGAACGTCTATAACCGCGCCC
TTAACAGCACCAGCCATAATCAGCTGACGCTTGGCTCAGGGGTGATTAT
GGATCAGCGCGGCTATATCCTGACCAACAAGCATGTTATCAACGATGCC
GATCAGATTATCGTCGCCCTGCAGGACGGCCGCGTCTTCGAAGCGCTGC
TGGTAGGATCCGATTCCCTCACNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNCAGGGGATTATCAGCGCCACAGGGCGCATTGGCCTCAATCCGA
CCGGCCGCCAGAACTTCCTGCAGACTGACGCCTCGATCAACCACGGTAA
CTCCGGCGGGGCNCTGGTGAACTCCCTCGGCGAGCTGATGGGGATTAAC
ACCCTCTCCTTTGACAAGAGCAATGACGGCGAAACGCCGGAAGGCATTG
GCTTTGCGATCCCGTTCCAGTTAGCGACCAAAATTATGGATAAACTGAT
CCGCGATGGCCGGGTGATCCGCGGCTATATCGGCATTAGCGGCCGGGAG
ATCGCCCCGCTGCACGCGCAGGGCGGAGGGATCGATCAGATTCAGGGGA
TCGTNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNG
CGCTGGAGACGATGGATCAGGTGGCCGAGATCCGCCCGGGATCGGAAAT
TCCGGTGGTCATCATGCGTGATGATAAGAAAATCACGCTCCATATCGCC
GTCCAGGAATACCCGGCCACCAACTAAN
```

By “KpMero4_C_KPN_04666 nucleic acid molecule” is meant a control polynucleotide that is 95%, 96%, 97%, 98%, or 100% identical to the following *Klebsiella pneumoniae* (strain MGH 78578, also known as ATCC 700721; reference genome NC_009648) sequence, excluding “N” residues, that is part of the KpMero4 probeset.

```
>KpMero4_C_KPN_04666
                                        (SEQ ID NO: 8)
NNNNNNNNNNNNNNNNNNNNNNNNNNNNNNNNNNNNNNNNNNNNNGTTGG
CGATCCTATTCATCCTGTTACTGATTTTCTTTTGTCAGAAATTAGTCAG
GATCCTCGGCGCCGCGGTGGATGGCGATATCCCAACCAATCTGGTGCTC
TCGCTGTTGGGGCTCGGCATCCCGGAGATGGCGCAGCTTATCCTGCCGT
TAAGTCTGTTCCTTGGCCTGCTNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNAACCCCGGTATGGCGGCGCTGGCCCAGGGCC
AGTTCCAGCAGGCCAGCGATGGTAACGCGGTGATGTTTATCGAAAGCGT
CAACGGCAACCGCTTCCATGACGTCTTCCTTGCCCAGCTGCGTCCGAAA
GGCAATGCGCGCCCCTCGGTGGTGGTGGCGGATTCCGGCGAGCTGTCGC
AGCAGAAAGACGGCTCGCAGGTGGTGACCCTCAACAAGGGCACCCGCTT
TGAAGGCACCGCGATGCTGCGCGANNNNNNNNNNNNNNNNNNNNNNNNNN
NNNNNNNNNNNNNNNNNNNNNNNNNNNNNNNNNNNNNNNNNNNNNNNNNN
```

-continued

```
NNNNNNNNNNNNNNNNNNNNNNNNNNNNNNNNNNNNNNACCGACCGCGCG
CGCGCCGAACTGCACTGGCGCTTCACGCTGGTGGCGACCGTCTTCATTA
TGGCGCTGATGGTGGTGCCGCTCAGCGTGGTGAACCCGCGTCAGGGCCG
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNGGC
TATCTGGATGTGGGCGATTAACCTGCTCTATTTTGCGCTGGCGGTGCTG
TTAAACCTGTGGGACACGGTGCCGATGCGCCGCTTCCGCGCCCGTTTTA
ATAAAGGAGCGGCCTGAN
```

By “KpMero4_ROlup_KPN_01226 nucleic acid molecule” is meant an upregulated responsive polynucleotide that is 95%, 96%, 97%, 98%, or 100% identical to the following *Klebsiella pneumoniae* (strain MGH 78578, also known as ATCC 700721) sequence, excluding “N” residues, that is part of the KpMero4 probeset.

```
>KpMero4_R01up_KPN_01226
                                        (SEQ ID NO: 9)
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNGAA
GAACGCCGCGCGATGCACGATCTGATCGCCAGCGACACCTTCGATAAGG
CGAAGGCGGAAGCGCAGATCGATAAGATGGAAGCGCAGCATAAAGCGAT
GGCGCTGTCCCGCCTGGAAACGCAGAACAAGATCTACAACATTCTGACN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNN
```

By “KpMero4_R02up_KPN_01107 nucleic acid molecule” is meant an upregulated responsive polynucleotide that is 95%, 96%, 97%, 98%, or 100% identical to the following *Klebsiella pneumoniae* (strain MGH 78578, also known as ATCC 700721) sequence, excluding “N” residues, that is part of the KpMero4 probeset.

```
>KpMero4_R02up_KPN_01107
                                        (SEQ ID NO: 10)
NNNNNNNNNNNNNNNNNNNNNNNNNNNNNNNNNNNNNNNNNNNNNNNNNN
NNNNNNNNNNNNNNNNNNNNNNNNNNNGTGGCTGCCGCGCTGGGCGTTGC
AGCTGTCGCTGGTCTCAACGTGTTGGATCGCGGCCCGCAGTATGCGCAA
GTGGTCTCCAGTACACCGATTAAAGAAACCGTGAAAACGCCGCGTCAGG
AATGCCGCAATGTCACGGTGACTCATCGTCGTCCGGTNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNN
```

-continued

NNNNNNNNNNNNNNNNNNNNNNNNNNNNNNNNNNNNNNNNNNNNNNNNNN

NNNNNNNNNNNNNNNNNNNNNNNNNNNNNN

By "KpMero4_R03up_KPN_02345 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

```
>KpMero4_R03up_KPN_02345
                                          (SEQ ID NO: 11)
ATGATGCGAATCGCGCTTTTCCTGCTGACGAACCTGGCAGTGATGGTCGT

GTTCGGGCTGGTGTTAAGCCTCACGGGGATCCAATCCAGCAGCATGACCG

GTCTTCTGATTATGGCCCTGCTGTTCGGCTTCGGTGGTTCTATCGTTTCG

CTGATGATGTCGAAGTGGATGGCGCTGAAGTCNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNN
```

By "KpMero4_R04up_KPN_02742 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

```
>KpMero4_R04up_KPN_02742
                                          (SEQ ID NO: 12)
NNNNNNNNNNNNNNNNNNNNNNNNNNNNNNNNNNNNNNNNNNNNNNNNNN

NNNNNNNNNNNNNNNNNNNATCACCCTGCTGCCATCGGTAAAATTACAAA

TAGGCGATCGTGACAATTACGGTAACTACTGGGACGGTGGCAGCTGGCGC

GACCGTGATTACTGGCGTCGTCACTATGAATGGCGTGATAACCGTTGGCA

TCGTCATGACAACGGCTGGCACN
```

By "KpMero4_R05dn_KPN_02241 nucleic acid molecule" is meant a downregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

```
>KpMero4_R05dn KPN_02241
                                          (SEQ ID NO: 13)
ATGAAACGCAAAAACGCTTCGTTACTCGGTAACGTACTCATGGGGTTAGG

GTTGGTGGTGATGGTTGTGGGGGTAGGTTACTCCATTCTGAACCAGCTTC

CGCAGCTTAACCTGCCACAATTCTTTGCGCATGGCGCAATCCTAAGCATC

TTCGTTGGCGCAGTGCTCTGGCTGGCCGGTGCCCGTATTGGCGGCCACGA

GCAGGTCAGCGACCGCTACTGGTGGGTGCGCCACTACGATAAACGCTGCC

GTCGTAACCAGCATCGTCACAGCTAAN
```

By "KpMero4_R06up_KPN_03358 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

```
>KpMero4_R06up_KPN_03358
                                          (SEQ ID NO: 14)
NNNNNNNNNNNNNNNNNNNNNNNNNNNNNNNNNNNNNNNNNNNNNNNNNN

NNNNNNNNNNNNNNNNNNNNNNNNNAACATGGACTCCAACGGTCTGCTCA

GCTCAGGCGCCGAAGCCTTCCAGGCATACTCTCTCAGCGACGCGCAGGTG

AAAACCTTAAGCGACCAGGCCTGTAAAGAGATGGACGCCAAAGCGAAAAT

CGCCCCGGCCAACAGTGAATACAGCCAGCGGCTGAACAAAATCGCGNCTG

CGCTGGGCGATAACATCAATGGTCAGCCCGTGAACTACAAGGTCTATGAG

ACCAAGGATGTCAACGCCTTCGCCATGGCCAACGGCTGCATCCGCGTCTA

CAGCGGGCTGATGGATCTGATGAACGATAATGAAGTCGAGGCGGNGATCG

GCCACGAAATGGGCCACGTCGCGCTGGGCCACGTGAAGAAAGGCATGCAG

GTCGCCCTGGGTACCAACGCCGTGCGTGCGGCGGCGGCCTCCGCGGGCGG

NNNNNNNNNAGCCTGTCGCAGTCTCAGTTGGGCGATCTGGGCGAAAAACT

GGTGAACTCGCAGTTCTCCCAGCGTCAGGAATCGGAAGCGGATGACTACT

CTTACGACCTGCTGCGTAAGCGCGGTATCAATCCGTCGGGACTGGCCACC

AGCTTCGAGAAACTGGCCAAGCTGGAAGCCGGCCGTCAGAGCTCCATGTT

TGACGATCACCCGGCATCNNNNNNNNNNNNNNNNNNNNNNNNNNNNNNNN

NNNNNNNNNNNNNNNNNNNNNNNN
```

By "KpMero4_R07up_KPN_03934 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

```
>KpMero4_R07up_KPN_03934
                                          (SEQ ID NO: 15)
NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

N----ATGCCTTATATTACCAAGCAGAATCAGGCGATTACTGCGGATCGT
```

-continued

AACTGGCTTATTTCCAAGCAGTACGATGCTCGCTGGTCGCCGACTGAGAA

GGCGCGCCTGAAGGATATCGCTNCCCGTTATAAGGTGAAGTGGTCAGGCA

ATACGCGTCATGTGCCCTGGAACGCGCTGCTTGAGCGTGTCGACATTATT

CCGAACAGCATGGTGGCGACCATGGCGGCGGCGGAAAGTGGCTGGGGTAC

CTCCAGGCTGGCGCGCGAGAATAACAACCTGTTCGGCATGAAGTGCGGCG

CCGGTCGCTGCCGCGGCGCGATGAAAGGTTACTCGCAGTTTGAGTCNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNNNNNNNNNNNNNN

By "KpMero4_R08dn_KPN_00868 nucleic acid molecule" is meant a downregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

>KpMero4_R08dn_KPN_00868

(SEQ ID NO: 16)

NNNNNNNNNNNNNNNNNNNNNNNNNNNNNNNNNNNNNNNNNNNNNNNNNN

NNNNNNNNNNNNNNNNNNNNNNNNNNNNNNNNNNGCCAATATCGATATTG

ACGCCTATCTGCAACTGCGAAAGGCCAAAGGCTACATGTCAGTCAGCGAA

AATGACCATCTGCGTGATAACTTGTTTGAGCTTTGCCGTGAAATGCGTGC

GCAGGCGCCGCGCCTGCAGAATGCCATTTCACCGNNNNNNNNNNNNNNNN

NNNNNNNNNNGGCGAATCGGTCGCCGCCGCTGCACTATGCCTGATGAGCG

GGCATCATGATTGTCCGCTATACATCGCTGTTAACGTAGAGAAGCTAGAA

CGCTGTCTGACAGGATTGACCTCAAATATTCATAAATTGAATAAATTGGC

GCCAATCACTCATGCCTGAN

By "KpMero4_R09up_KPN_02342 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

>KpMero4_R09up_KPN_02342

(SEQ ID NO: 17)

NNNNNNNNNNNNNNNNNNNNNNNNNNNNNNGTGGCTATCTTATGGATTGG

CGTATTATTGAGCGGTTATGGGGTGTTATTCCACAGTGAGGAAAACGTCG

GCGGTCTGGGTCTTAAGTGCCAATACCTCACCGCCCGCGGAGTCAGCACC

GCACTTTATGTTCATTCCGACAGCGGAGTGATCGGCGTCAGCAGTTGCCC

TCTGCTGCGTAAAAGCACAACCGTGGTTGATAACGGCTAAN

By "KpMero4_R10up_KPN_00833 nucleic acid molecule" is meant an upregulated responsive polynucleotide that is 95%, 96%, 97%, 98%, or 100% identical to the following *Klebsiella pneumoniae* (strain MGH 78578, also known as ATCC 700721) sequence, excluding "N" residues, that is part of the KpMero4 probeset.

>KpMero4_R10up_KPN_00833

(SEQ ID NO: 18)

NNNNNNNNNNNNNNNNNNNNNNNNNNNNNNNNNNNNNNNNNNNNNNNNNN

NNNNNNNNNNNNNNNNNNNNNNNNNNNNNNNNNNNNNNNNNNNNNNNNNN

NNNNNNNATCGGCGTGGTGTCTGCGCAAGGCGCAACCACTTTAGATGGTC

TGGAAGCAAAACTGGCTGCTAAAGCCGAAGCCGCTGGCGCGACCGGCTAC

AGCATTACTTCCGCTAACACCAACAACAAACTGAGCGGTACTGCGGTTAT

CTATAAATAAN

By "CRE2_KPC nucleic acid molecule" is meant a polynucleotide that is 95%, 96%, 97%, 98%, or 100% identical to the following sequence, and is part of the Cre2 probeset.

>CRE2_KPC (SEQ ID NO: 19)

TATCGCCGTCTAGTTCTGCTGTCTTGTCTCTCATGGCCGCTGGCTGGCTT

TTCTGCCACCGCGCTGACCAACCTCGTCGCGGAACCATTCGCTAAACTCG

AACAGGACTTTGGCGGCTCCATCGGTGTGTACGCGATGGATACCGGCTCA

GGCGCAACTGTAAGTTACCGCGCTGAGGAGCGCTTCCCACTGTGCAGCTC

ATTCAAGGGCTTTCTTGCTGCCGCTGTGCTGGCTCGCAGCCAGCAGCAGG

CCGGCTTGCTGGACACACCCATCCGTTACGGCAAAAATGCGCTGGTTCCG

TGGTCACCCATCTCGGAAAAATATCTGACAACAGGCATGACGGTGGCGGA

GCTGTCCGCGGCCGCCGTGCAATACAGTGATAACGCCGCCGCCAATTTGT

TGCTGAAGGAGTTGGGCGGCCCGGCCGGGCTGACGGCCTTCATGCGCTCT

ATCGGCGATACCACGTTCCGTCTGGACCGCTGGGAGCTGGAGCTGAACTC

CGCCATCCCAGGCGATGCGCGCGATACCTCATCGCCGCGCGCCGTGACGG

AAAGCTTACAAAAACTGACACTGGGCTCTGCACTGGCTGCGCCGCAGCGG

CAGCAGTTTGTTGATTGGCTAAAGGGAAACACGACCGGCAACCACCGCAT

CCGCGCGGCGGTGCCGGCAGACTGGGCAGTCGGAGACAAAACCGGAACCT

GCGGAGTGTATGGCACGGCAAATGACTATGCCGTCGTCTGGCCCACTGGG

CGCGCACCTATTGTGTTGGCCGTCTACACCCGGGCGCCTAACAAGGATGA

CAAGCACAGCGAGGCCGTCATCGCCGCTGCGGCTAGACTCGCGCTCGAGG

GA

By "CRE2_NDM nucleic acid molecule" is meant a polynucleotide that is 95%, 96%, 97%, 98%, or 100% identical to the following sequence, and is part of the Cre2 probeset.

>CRE2_NDM (SEQ ID NO: 20)

ATGGAATTGCCCAATATTATGCACCCGGTCGCGAAGCTGAGCACCGCATT

AGCCGCTGCATTGATGCTGAGCGGGTGCATGCCCGGTGAAATCCGCCCGA

CGATTGGCCAGCAAATGGAAACTGGCGACCAACGGTTTGGCGATCTGGTT

TTCCGCCAGCTCGCACCGAATGTCTGGCAGCACACTTCCTATCTCGACAT

GCCGGGTTTCGGGGCAGTCGCTTCCAACGGTTTGATCGTCAGGGATGGCG

GCCGCGTGCTGGTGGTCGATACCGCCTGGACCGATGACCAGACCGCCCAG

ATCCTCAACTGGATCAAGCAGGAGATCAACCTGCCGGTCGCGCTGGCGGT

-continued

GGTGACTCACGCGCATCAGGACAAGATGGGCGGTATGGACGCGCTGCATG

CGGCGGGGATTGCGACTTATGCCAATGCGTTGTCGAACCAGCTTGCCCCG

CAAGAGGGGATGGTTGCGGCGCAACACAGCCTGACTTTCGCCGCCAATGG

CTGGGTCGAACCAGCAACCGCGCCCAACTTTGGCCCGCTCAAGGTATTTT

ACCCCGGCCCCGGCCACACCAGTGACAATATCACCGTTGGGATCGACGGC

ACCGACATCGCTTTTGGTGGCTGCCTGATCAAGGACAGCAAGGCCAAGTC

GCTCGGCAATCTCGGTGATGCCGACACTGAGCACTACGCCGCGTCAGCGC

GCGCGTTTGGTGCGGCGTTCCCCAAGGCCAGCATGATCGTGATGAGCCAT

TCCGCCCCCGATAGCCGCGCCGCAATCACTCATACGGCCCGCATGGCCGA

CAAGCTGCGCT

By "CRE2_OXA48 nucleic acid molecule" is meant a polynucleotide that is 95%, 96%, 97%, 98%, or 100% identical to the following sequence, and is part of the Cre2 probeset.

>CRE2_OXA48

(SEQ ID NO: 21)

ATGCGTGTATTAGCCTTATCGGCTGTGTTTTTGGTGGCATCGATTATCGG

AATGCCTGCGGTAGCAAAGGAATGGCAAGAAAACAAAAGTTGGAATGCTC

ACTTTACTGAACATAAATCACAGGGCGTAGTTGTGCTCTGGAATGAGAAT

AAGCAGCAAGGATTTACCAATAATCTTAAACGGGCGAACCAAGCATTTTT

ACCCGCATCTACCTTTAAAATTCCCAATAGCTTGATCGCCCTCGATTTGG

GCGTGGTTAAGGATGAACACCAAGTCTTTAAGTGGGATGGACAGACGCGC

GATATCGCCACTTGGAATCGCGATCATAATCTAATCACCGCGATGAAATA

TTCAGTTGTGCCTGTTTATCAAGAATTTGCCCGCCAAATTGGCGAGGCAC

GTATGAGCAAGATGCTACATGCTTTCGATTATGGTAATGAGGACATTTCG

GGCAATGTAGACAGTTTCTGGCTCGACGGTGGTATTCGAATTTCGGCCAC

GGAGCAAATCAGCTTTTTAAGAAAGCTGTATCACAATAAGTTACACGTAT

CGGAGCGCAGCCAGCGTATTGTCAAACAAGCCATGCTGACCGAAGCCAAT

GGTGACTATATTATTCGGGCTAAAACTGGATACTCGACTAGAATCGAACC

TAAGATTGGCTGGTGGGTCGGTTGGGTTGAACTTGATGATAATGTGTGGT

TTTTTGCGATGAATATGGATATGCCCACATCGGATGGTTTAGGGCTGCGC

CAAGCCATCACAAAAGAAGTGCTCAAACAGGAAAAAATTATTCCCT

By "CRE2_CTXM15 nucleic acid molecule" is meant a polynucleotide that is 95%, 96%, 97%, 98%, or 100% identical to the following sequence, and is part of the Cre2 probeset.

>CRE2_CTXM15

(SEQ ID NO: 22)

ATGGTTAAAAAATCACTGCGCCAGTTCACGCTGATGGCGACGGCAACCGT

CACGCTGTTGTTAGGAAGTGTGCCGCTGTATGCGCAAACGGCGGACGTAC

AGCAAAAACTTGCCGAATTAGAGCGGCAGTCGGGAGGCAGACTGGGTGTG

GCATTGATTAACACAGCAGATAATTCGCAAATACTTTATCGTGCTGATGA

GCGCTTTGCGATGTGCAGCACCAGTAAAGTGATGGCCGCGGCCGCGGTGC

TGAAGAAAAGTGAAAGCGAACCGAATCTGTTAAATCAGCGAGTTGAGATC

-continued

AAAAAATCTGACCTTGTTAACTATAATCCGATTGCGGAAAAGCACGTCAA

TGGGACGATGTCACTGGCTGAGCTTAGCGCGGCCGCGCTACAGTACAGCG

ATAACGTGGCGATGAATAAGCTGATTGCTCACGTTGGCGGCCCGGCTAGC

GTCACCGCGTTCGCCCGACAGCTGGGAGACGAAACGTTCCGTCTCGACCG

TACCGAGCCGACGTTAAACACCGCCATTCCGGGCGATCCGCGTGATACCA

CTTCACCTCGGGCAATGGCGCAAACTCTGCGGAATCTGACGCTGGGTAAA

GCATTGGGCGACAGCCAACGGGCGCAGCTGGTGACATGGATGAAAGGCAA

TACCACCGGTGCAGCGAGCATTCAGGCTGGACTGCCTGCTTCCTGGGTTG

TGGGGGATAAAACCGGCAGCGGTGGCTATGGCACCACCAACGATATCGCG

GTGATCTGGCCAAAAGATCGTGCGCCGCTGATTCTGGTCACTTACTTCAC

CCAGCCTCAACCTAAGGCAGAAAGCCGTCGCGATGTATTAGCGTCGGCGG

CTAAAATCGTCACCGACGGTTTGT

By "CRE2_OXA10 nucleic acid molecule" is meant a polynucleotide that is 95%, 96%, 97%, 98%, or 100% identical to the following sequence, and is part of the Cre2 probeset.

>CRE2_OXA10

(SEQ ID NO: 23)

ATGAAAACATTTGCCGCATATGTAATTATCGCGTGTCTTTCGAGTACGGC

ATTAGCTGGTTCAATTACAGAAAATACGTCTTGGAACAAAGAGTTCTCTG

CCGAAGCCGTCAATGGTGTCTTCGTGCTTTGTAAAAGTAGCAGTAAATCC

TGCGCTACCAATGACTTAGCTCGTGCATCAAAGGAATATCTTCCAGCATC

AACATTTAAGATCCCCAACGCAATTATCGGCCTAGAAACTGGTGTCATAA

AGAATGAGCATCAGGTTTTCAAATGGGACGGAAAGCCAAGAGCCATGAAG

CAATGGGAAAGAGACTTGACCTTAAGAGGGGCAATACAAGTTTCAGCTGT

TCCCGTATTTCAACAAATCGCCAGAGAAGTTGGCGAAGTAAGAATGCAGA

AATACCTTAAAAAATTTTCCTATGGCAACCAGAATATCAGTGGTGGCATT

GACAAATTCTGGTTGGAAGGCCAGCTTAGAATTTCCGCAGTTAATCAAGT

GGAGTTTCTAGAGTCTCTATATTTAAATAAATTGTCAGCATCTAAAGAAA

ACCAGCTAATAGTAAAAGAGGCTTTGGTAACGGAGGCGGCACCTGAATAT

CTAGTGCATTCAAAAACTGGTTTTTCTGGTGTGGGAACTGAGTCAAATCC

TGGTGTCGCATGGTGGGTTGGGTGGGTTGAGAAGGAGACAGAGGTTTACT

TTTTCGCCTTTAACATGGATATAGACAACGAAAGTAAGTTGCCGCTAAGA

AAATCCATTCCCACCAAAATCATGGAAAGTGAGGGCATCATTGGTGGCT

By "CRE2_VIM_1 nucleic acid molecule" is meant a polynucleotide that is 95%, 96%, 97%, 98%, or 100% identical to the following sequence, and is part of the Cre2 probeset.

>CRE2_VIM_1

(SEQ ID NO: 24)

ATGTTTCAA---ATTCGCAGCTTTCTGGTTGGTATCAGTGCATTCGTCAT

GGCCGTACTTGGATCAGCAGCATATTCCGCACAGCCTGGCGGTGAATATC

CGACAGTAGATGACATACCGGTAGGGGAAGTTCGGCTGTACAAGATTGGC

-continued

GATGGCGTTTGGTCGCATATCGCAACTCAGAAACTCGGTGACACGGTGTA

CTCGTCTAATGGACTTATCGTCCGCGATGCTGATGAGTTGCTTCTTATTG

ATACAGCGTGGGGGGCGAAGAACACGGTAGCCCTTCTCGCGGAGATTGAA

AAGCAAATTGGACTTCCAGTAACGCGCTCAATTTCTACGCACTTCCATGA

CGATCGAGTCGGTGGAGTTGATGTCCTCCGGGCGGCTGGAGTGGCAACGT

ACACCTCACCCTTGACACGCCAGCTGGCCGAAGCGGCGGGAAACGAGGTG

CCTGCGCACTCTCTAAAAGCGCTCTCCTCTAGTGGAGATGTGGTGCGCTT

CGGTCCCGTAGAGGTTTTCTATCCTGGTGCTGCGCATTCGGGCGACAATC

TTGTGGTATACGTGCCGGCCGTGCGCGTACTGTTTGGTGGCTGTGCAGTT

CATGAGGCGTCACGCGAATCCGCGGGTAATGTTGCCGATGCCAATTTGGC

AGAATGGCCTGCTACCATTAAACGAATTCAACAGCGGTATCCGGAAGCAG

AGGTCGTCATCCCCGGCCACGGTCTACCGGGCGGTCTGGAATTGCTCCAA

CACACAACTAACGTTGTCAAAACGCACAAAGTACGCCCGGTGGCCGAGT

By “CRE2_VIM_2 nucleic acid molecule” is meant a polynucleotide that is 95%, 96%, 97%, 98%, or 100% identical to the following sequence, and is part of the Cre2 probeset.

>CRE2_VIM_2

(SEQ ID NO: 25)

CGAGTGGTGAGTATCCGACAGTCAACGAAATTCCGGTCGGAGAGGTCCGG

CTTTACCAGATTGCCGATGGTGTTTGGTCGCATATCGCAACGCAGTCGTT

TGATGGCGCGGTCTACCCGTCCAATGGTCTCATTGTCCGTGATGGTGATG

AGTTGCTTTTGATTGATACAGCGTGGGGTGCGAAAAACACAGCGGCACTT

CTCGCGGAGATTGAGAAGCAAATTGGACTTCCCGTAACGCGTGCAGTCTC

CACGCACTTTCATGACGACCGCGTCGGCGGCGTTGATGTCCTTCGGGCGG

CTGGGGTGGCAACGTACGCATCACCGTCGACACGCCGGCTAGCCGAGG

By “CRE2_VIM_3 nucleic acid molecule” is meant a polynucleotide that is 95%, 96%, 97%, 98%, or 100% identical to the following sequence, and is part of the Cre2 probeset.

>CRE2_VIM_3

(SEQ ID NO: 26)

TACCCGTCCAATGGTCTCATTGTCCGTGATGGTGATGAGTTGCTTTTGAT

TGATACAGCGTGGGGTGCGAAAAACACAGCGGCACTTCTCGCGGAGATTG

AGAAGCAAATTGGACTTCCCGTAACGCGTGCAGTCTCCACGCACTTTCAT

GACGACCGCGTCGGCG

By “CRE2_IMP_1 nucleic acid molecule” is meant a polynucleotide that is 95%, 96%, 97%, 98%, or 100% identical to the following sequence, and is part of the Cre2 probeset.

>CRE2_IMP_1

(SEQ ID NO: 27)

GGAGCGGCTTTGCCTGATTTAAAAATCGAGAAGCTTGAAGAAGGTGTTTA

TGTTCATACATCGTTCGAAGAAGTTAACGGTTGGGGTGTTGTTTCTAAAC

-continued

ACGGTTTGGTGGTTCTTGTAAACACTGACGCCTATCTGATTGACACTCCA

TTT

By “CRE2_IMP_2 nucleic acid molecule” is meant a polynucleotide that is 95%, 96%, 97%, 98%, or 100% identical to the following sequence, and is part of the Cre2 probeset.

>CRE2_IMP_2

(SEQ ID NO: 28)

ACTGAAAAGTTAGTCAATTGGTTTGTGGAGCGCGGCTATAAAATCAAAGG

CACTATTTCCTCACATTTCCATAGCGACAGCACAGGNGGAATAGAGTGGC

TTAATTCTCAATCTATTCCCACGTATGCATCTGAATTAACAAATGAACTT

By “CRE2_IMP_3 nucleic acid molecule” is meant a polynucleotide that is 95%, 96%, 97%, 98%, or 100% identical to the following sequence, and is part of the Cre2 probeset.

>CRE2_IMP_3

(SEQ ID NO: 29)

TCATTTAGCGGAGTTAGTTATTGGCTAGTTAAAAATAAAATTGAAGTTTT

TTATCCCGGCCCGGGGCACACTCAAGATAACGTAGTGGTTTGGTTACCTG

AAAAGAAAATTTTATTCGGTGGTTGTTTTGTTAAACCGGACGGTCTTGGT

AATTTGG

By “CRE2_IMP_4 nucleic acid molecule” is meant a polynucleotide that is 95%, 96%, 97%, 98%, or 100% identical to the following sequence, and is part of the Cre2 probeset.

>CRE2_IMP_4

(SEQ ID NO: 30)

CTGACGCCTATCTGATTGACACTCCATTTACTGCTACAGATACTGAAAAG

TTAGTCAATTGGTTTGTGGAGCGCGGCTATAAAATCAAAGGCACTATTTC

CTCACATTTCCATAGCGACAGCACAGGGGGAATAGAGTGGCTTAATTCTC

By “CRE2_IMP_5 nucleic acid molecule” is meant a polynucleotide that is 95%, 96%, 97%, 98%, or 100% identical to the following sequence, and is part of the Cre2 probeset.

>CRE2_IMP_5

(SEQ ID NO: 31)

ATGAAAAAAATATTTGTGTTATTTGTATTTTTGTTTTGCAGTATTACTGC

CGCCGGAGAGTCTTTGCCTGATATAAAAATTGAGAAACTTGACGAAGATG

TTTATGTTCATACTTCTTTTGAAAAAAAAAACGGCTGGGGTGTTATTACT

AAACACGGCTTGGTGGTTCTTGTAAATACTGATGCCTATATAATTGACAC

TCCATTTACAGCTAAAGATACTGAAAAATTAGTCCGCTGGTTTGTGGGGC

GTGGTTATAAAATCAAAGGCAGTATTTCCTCACATTTTCATAGCGATAGC

GCAGGTGGAATTGAGTGGCTTAATTCTCAATCTATCCCCACATATGCATC

TAAATTAACAAATGAGCTTCTTAAAAAGAACGGTAATGCGCAAGCCGAAA

ACTCATTTAGTGGCGTTAGCTATTGGCTAGTTAAACATAAAATTGAAGTT

TTCTATCCAGGACCAGGGCACACTCAGGATAATGTAGTGGTTTGGTTGCC

-continued

TGAAAAGAAAATTTTATTTGGCGGTTGTTTTATTAAGCCGGACGGTCTTG

GTTATTTGGGAGACGCAAATCTAGAAGCATGGCCTAAGTCCGCAGAAACA

TTAATGTCTAAGTATGGTAATGCAAAACTGGTTGTTTCGAGTCATAGTGA

AATTGGGGGCGCATCACTATTGAAGCGCACTTGGGAGCAGGCTGTTAAGG

GGCTAAAAGAAAGTAAAAAACCATCACAGCCAAACAAA

By "CRE2_IMP_6 nucleic acid molecule" is meant a polynucleotide that is 95%, 96%, 97%, 98%, or 100% identical to the following sequence, and is part of the Cre2 probeset.

>CRE2_IMP_6
(SEQ ID NO: 32)
CTGAGGCTTATCTAATTGACACTCCATTTACGGCTAAAGATACTGAAAAG

TTAGTCACTTGGTTTGTGGAACGTGGCTATAAAATAAAAGGCAGTATTTC

CTCTCATTTTCATAGCGACAGCACGGGCGGAATAGAGTGGCTTAATTCTC

AATCTATCCCCACGTATGCATCTGAATTAACAAATG

By "CRE2_IMP_7 nucleic acid molecule" is meant a polynucleotide that is 95%, 96%, 97%, 98%, or 100% identical to the following sequence, and is part of the Cre2 probeset.

>CRE2_IMP_7
(SEQ ID NO: 33)
TATGCATCTGAATTAACAAATGAACTTCTTAAAAAAGACGGTAAGGTACA

AGCTAAAAATTCATTTAGCGGAGTTAGCTATTGGCTAGTTAAGAAAAAGA

TTGAAGTTTTTTATCCTGGTCCAGGGCACACTCCAGATAACGTAGTGGTT

TGGC

By "CRE2_IMP_8 nucleic acid molecule" is meant a polynucleotide that is 95%, 96%, 97%, 98%, or 100% identical to the following sequence, and is part of the Cre2 probeset.

>CRE2_IMP_8
(SEQ ID NO: 34)
GGGCACACTCAAGATAACGTAGTGGTTTGGTTACCTGAAAAGAAAATTTT

ATTCGGTGGTTGTTTTGTTAAACCGGACGGTCTTGGTAATTTGGGTGACG

CAAATTTAGAAGCTTGGCCAAAGTCCGCCAAAATATTAATGTCTAAATAT

G

Other features and advantages of the disclosure will be apparent from the following description of the preferred embodiments thereof, and from the claims. Unless otherwise defined, all technical and scientific terms used herein have the same meaning as commonly understood by one of ordinary skill in the art to which this disclosure belongs. Although methods and materials similar or equivalent to those described herein can be used in the practice or testing of the present disclosure, suitable methods and materials are described below. All published foreign patents and patent applications cited herein are incorporated herein by reference. All other published references, documents, manuscripts and scientific literature cited herein are incorporated herein by reference. In addition, the materials, methods, and examples are illustrative only and not intended to be limiting.

BRIEF DESCRIPTION OF THE DRAWINGS

The following detailed description, given by way of example, but not intended to limit the disclosure solely to the specific embodiments described, may best be understood in conjunction with the accompanying drawings, in which:

FIG. 1A shows the bipartite probe bound to an exemplary target nucleic acid. FIG. 1B shows an exemplary embodiment in which Probe A and Probe B may be detected by tags that are directly coupled to one or both Probes. FIG. 1C shows an exemplary embodiment in which Probe A and Probe B may be detected by tags that are in directly coupled to one or both Probes.

FIG. 2A demonstrates that RNA-Seq data upon antibiotic exposure revealed differential gene expression between susceptible and resistant strains. Susceptible (left panels) or resistant (right panels) clinical isolates of *K. pneumoniae* (top), *E. coli* (middle), or *A. baumannii* (bottom) were treated with meropenem (left, 60 min), ciprofloxacin (center, 30 min), or gentamicin (right, 60 min) at CLSI breakpoint concentrations. Data are presented as MA plots, with mean transcript abundance plotted on the x-axis and fold-induction compared with untreated strains on the y-axis; each axis is $\log_2$ transformed. Transcripts whose expression was observed as statistically significantly changed upon antibiotic exposure are shown in red. FIGS. 2B-2D show that a timecourse of RNA-Seq data upon antibiotic exposure revealed differential gene expression between susceptible and resistant clinical isolates. Susceptible (left panels) or resistant (right panels) clinical isolates of *K. pneumoniae* (FIG. 2B), *E. coli* (FIG. 2C), or *A. baumannii* (FIG. 2D) were treated with meropenem (left), ciprofloxacin (center), or gentamicin (right) at CLSI breakpoint concentrations for the indicated times. Data are presented as MA plots, with mean transcript abundance plotted on the x-axis and fold-induction compared with untreated strains on the y-axis; each axis is $\log_2$ transformed. Transcripts whose expression is statistically significantly changed upon antibiotic exposure are shown in red.

FIG. 4A shows phase 1 NanoString® data from FIGS. 2A-2D above (i.e., normalized, log-transformed fold-induction for each responsive transcript), analyzed as described to generate squared projected distance (SPD) metrics (y-axes) for each strain (see Supplemental Methods below), and binned by CLSI classifications (x-axes), for the same 18-24 isolates shown in FIGS. 3 above and 6 and 7A below. By definition, an SPD of 0 indicates a transcriptional response to antibiotic equivalent to that of an average susceptible strain, while an SPD of 1 indicates a response equivalent to that of an average resistant strain. See Supplemental Methods sections below for details. Data are summarized as box-and-whisker plots, where boxes extend from 25th to 75th percentile for each category, with middle line at median, and whiskers extending from minimum to maximum; all data points are displayed as well. Note that for *A. baumannii* and meropenem, the clustering of the majority of susceptible strains by this simple metric (aside from one outlier which was misclassified as resistant by GoPhAST-R) underscores the true differences in transcription between susceptible and resistant isolates, despite the more subtle-appearing differences in heatmaps for this combination (FIGS. 3 and 6), which is largely caused by one strain exhibiting an exaggerated transcriptional response (seen here as the strain with a markedly negative SPD) that affects scaling of the heatmap. FIG. 4B shows the same SPD data (y-axes) plotted against broth microdilution MICs (x-axes), which revealed that the magnitude of the transcriptional response to antibiotic exposure correlated with MIC. In both FIGS. 4A and 4B, strains with large inoculum effect upon meropenem treatment have been displayed in red and enlarged. Vertical dashed line indicates the CLSI breakpoint between susceptible and not susceptible (i.e., intermediate or resistant).

FIG. 7A shows the probability of resistance obtained from a random forest model trained on NanoString® data and tested on validation cohort (y-axis), as compared with standard CLSI classification based on broth microdilution MIC (x-axis), for the nine indicated pathogen-antibiotic combinations tested in phase 1. FIG. 7B shows the probability of resistance obtained from a random forest model trained on NanoString® data and tested on validation cohort (y-axis), as compared with standard CLSI classification based on broth microdilution MIC (x-axis), for the new *K. pneumoniae* isolates tested in phase 2 for meropenem and ciprofloxacin susceptibility. Horizontal dashed lines indicate 50% chance of resistance based on random forest model. Vertical dashed lines indicate CLSI breakpoint between susceptible and not susceptible (i.e. intermediate/resistant); isolates also colored by CLSI classification as indicated. Numbers in each quadrant indicate concordant (green) and discordant (black) classifications between GoPhAST-R and broth microdilution. Carbapenemase (square outline) and select ESBL (diamond outline) gene content as detected by GoPhAST-R are also displayed on meropenem plots (none were found in the *A. baumannii* validation cohort). *=strains with large inoculum effects in meropenem MIC.

FIG. 11A shows heatmaps of normalized, log-transformed fold-induction NanoString® data from the top 10 antibiotic-responsive transcripts directly from 12 simulated positive blood culture bottles for each indicated pathogen-antibiotic combination, which revealed antibiotic-responsive transcription in susceptible but not resistant isolates. For meropenem, results of carbapenemase/ESBL gene detection are also displayed as a normalized, background-subtracted, log-transformed heatmap above. CLSI classifications of isolates, which were blinded until analysis was complete, are displayed below each heatmap. FIG. 11B shows the probability of resistance from random forest model trained by leave-one-out cross-validation on NanoString® data from FIG. 11A (y-axis) compared with standard CLSI classification based on broth microdilution MIC (x-axis) for each isolate. Horizontal dashed lines indicate 50% chance of resistance based on random forest model. Vertical dashed lines indicate CLSI breakpoint between susceptible and resistant; isolates have also been colored by CLSI classification as indicated. Carbapenemase (square outline) and select ESBL (diamond outline) gene content as detected by GoPhAST-R are also displayed on meropenem plots. See Supplemental Methods for details of spike-in protocol.

FIG. 12A shows a schematic of GoPhAST-R workflow on the Hyb & Seq detection platform. It is contemplated that pathogen identification can either be performed prior to this process, or in parallel by multiplexing mRNA targets from multiple organisms. FIG. 12B, at left, shows the Hyb & Seq hybridization scheme, in which probe pairs targeting each RNA transcript are hybridized in crude lysate. Each probe A contains a unique barcode sequence (green) for detection and a shared 3' capture sequence; each probe B contains a biotin group (gray circle) for surface immobilization and a shared 5' capture sequence. At middle, the Hyb & Seq detection strategy is shown: immobilized, purified ternary probe-target complexes undergo sequential cycles of multi-step imaging for spatially resolved single-molecule detection. Each cycle consists of reporter probe binding and detection, UV cleavage, a second round of reporter probe binding and detection, and a low-salt wash to regenerate the unbound probe-target complex. 5 Hyb & Seq cycles were used to generate the data shown. See Supplemental Methods sections below for details. At right, pilot study results for accelerated meropenem susceptibility testing of 6 clinical *K. pneumoniae* isolates are shown. At right top, heatmaps of normalized, log-transformed fold-induction of top 10 meropenem-responsive transcripts measured using the instant Hyb & Seq workflow are shown, with strains arranged in order of MIC for each antibiotic. CLSI classifications are shown immediately below. At right bottom, heatmaps of normalized, background-subtracted, log-transformed NanoString® data from carbapenemase ("CPase") and select ESBL transcripts measured in the same Hyb & Seq assay are shown.

FIG. 13A shows phylogenetic trees of all sequenced isolates deposited in NCBI for *Klebsiella pneumoniae* isolates, with all sequenced isolates used in the instant disclosure indicated by colored arrowheads around the periphery. FIG. 13B shows phylogenetic trees of all sequenced isolates deposited in NCBI for *Escherichia coli* isolates, with all sequenced isolates used in the instant disclosure indicated by colored arrowheads around the periphery. FIG. 13C shows phylogenetic trees of all sequenced isolates deposited in NCBI for *Acinetobacter baumanii* isolates isolates, with all sequenced isolates used in the instant disclosure indicated by colored arrowheads around the periphery. FIG. 13D shows phylogenetic trees of all sequenced isolates deposited in NCBI for *Pseudomonas aeruginosa* isolates, with all sequenced isolates used in the instant disclosure indicated by colored arrowheads around the periphery (ciprofloxacin sensitive strains are indicated by blue arrowheads and ciprofloxacin resistant strains are indicated by red arrowheads). See Supplemental Methods sections below for details.

FIG. 14A shows RNA-Seq data from susceptible or resistant clinical isolates of *S. aureus* treated with the indicated fluoroquinolone levofloxacin at 1 mg/L for 60 minutes. Data are presented as MA plots, with mean transcript abundance plotted on the x-axis and fold-induction compared with untreated strains on the y-axis; each axis is $\log_2$ transformed. Transcripts whose expression is statistically significantly changed upon antibiotic exposure are shown in red. FIG. 14B shows heatmaps of normalized, log-transformed fold-induction of antibiotic-responsive transcripts from 24 clinical isolates of *S. aureus* treated with the indicated fluoroquinolone levofloxacin at 1 mg/L for 60 minutes. NanoString® data from all candidate transcripts are shown at left, and top 10 transcripts selected from Phase 1 testing are shown at right. (FIG. 14C=*S. aureus*+levofloxacin; FIG. 14F=*P. aeruginosa*+ciprofloxacin) FIG. 14C depicts the probability of *S. aureus* resistance to the indicated fluoroquinolone levofloxacin from random forest model trained on Phase 1 NanoString® data from derivation cohort and tested on validation cohort (y-axis) compared with standard CLSI classification based on broth microdilution MIC (x-axis). Horizontal dashed lines indicate 50% chance of resistance based on random forest model. Vertical dashed lines indicate CLSI breakpoint between susceptible and not susceptible (i.e. intermediate/resistant); isolates also colored by CLSI classification as indicated. Numbers in each quadrant indicate concordant (green) and discordant (black) classifications between GoPhAST-R and broth microdilution. FIG. 14D shows RNA-Seq data from susceptible or resistant clinical isolates of *P. aeruginosa* treated with the indicated fluoroquinolone ciprofloxacin at 1 mg/L for 60 minutes. Data are presented as MA plots, with mean transcript abundance plotted on the x-axis and fold-induction compared with untreated strains on the y-axis; each axis is $\log_2$ transformed. Transcripts whose expression is statistically significantly changed upon antibiotic exposure are shown in red. FIG. 14E shows heatmaps of normalized, log-transformed fold-induction of antibiotic-responsive transcripts from 24 clinical isolates of *P. aeruginosa* treated with the indicated fluoroquinolone ciprofloxacin at 1 mg/L for 60 minutes. NanoString® data from all candidate transcripts are shown at left, and top 10 transcripts selected from Phase 1 testing are shown at right.

FIG. 14F depicts the probability of *P. aeruginosa* resistance to the indicated fluoroquinolone ciprofloxacin from random forest model trained on Phase 1 NanoString® data from derivation cohort and tested on validation cohort (y-axis) compared with standard CLSI classification based on broth microdilution MIC (x-axis). Horizontal dashed lines indicate 50% chance of resistance based on random forest model. Vertical dashed lines indicate CLSI breakpoint between susceptible and not susceptible (i.e. intermediate/resistant); isolates also colored by CLSI classification as indicated. Numbers in each quadrant indicate concordant (green) and discordant (black) classifications between GoPhAST-R and broth microdilution.

DETAILED DESCRIPTION OF THE DISCLOSURE

Figure 1A:
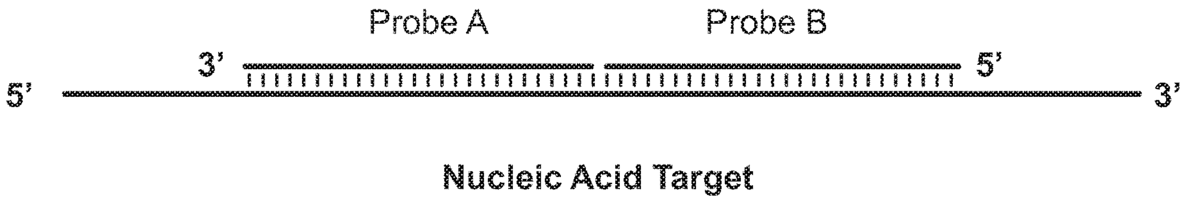
FIGS. 1A-1C are diagrams depicting a binding and detection of a bipartite probe structure including Probe A and Probe B according to an exemplary embodiment of the disclosure.

The present disclosure is based, at least in part, on the discovery of specific mRNA signature patterns that provide rapid phenotypic detection of single and multiple types of antibiotic resistance/susceptibility in specific microbial organisms (e.g., bacteria). In particular, the techniques herein relate, at least in part, to compositions, methods, and kits for rapid antibiotic susceptibility testing (AST) in microbial organisms (e.g., bacteria). The techniques herein provide compositions and methods that provide rapid phenotypic detection of antibiotic resistance/susceptibility in microbial pathogens, and are faster than the prior art growth-based phenotypic assays that currently comprise the gold standard. The techniques herein also provide compositions and methods that enable simultaneous detection of multiple resistance genes in the same assay. In this manner, the techniques herein enable more accurate determination of antibiotic resistance, as well as providing: 1) mechanistic explanations for key antibiotic resistant strains, 2) epidemiologic tracking of known resistance mechanisms, and 3) immediate identification of unknown or potentially novel resistance mechanisms (such as, e.g., discordant cases when a resistant organism does not display a known resistance phenotype). Currently, detection of antibiotic resistance genes typically requires separate PCR or sequencing assays, which require different assay infrastructure and often necessitate sending samples out to reference laboratories.

The techniques herein may be used for clinical diagnostics, e.g., to rapidly determine antibiotic susceptibility profiles on patient samples and easily allow antibiotic susceptibility testing (AST) to be performed on bacteria from any source, including environmental isolates. The techniques herein are based on the following steps: sample acquisition, processing to enrich for bacteria and remove host material (in order to increase signal-to-noise), antibiotic exposure, bacterial lysis, RNA measurement (hybridization followed by detection), and data interpretation. Advantageously, the techniques herein may be implemented within a single reaction that does not require sample purification.

As mentioned above, current growth-based antibiotic susceptibility testing (AST) is too slow to inform key clinical decisions. While genotypic assays hold promise, they remain incompletely predictive of susceptibility. The techniques herein provide rapid assays for combined genotypic and phenotypic AST through RNA detection (i.e., GoPhAST-R) that classifies strains with >94-99% accuracy by coupling machine learning analysis of quantitative early transcriptional responses to antibiotic exposure with simultaneous detection of key genetic resistance determinants. This two-pronged approach provides phenotypic AST as fast as <4 hours, increases accuracy of resistance detection, works directly from positive blood cultures, facilitates molecular epidemiology, and enables early detection of emerging resistance mechanisms.

Antibiotic resistance is one of the most pressing medical problems of modern times (Fauci & Morens; Nathan & Cars). The rise of multidrug resistant organisms (MDROs) has been recognized as one of the most serious threats to human health (Holdren et al.; WHO). Delays in identifying MDROs can lead to increased mortality (Kumar et al.; Kadri et al.) and increased use of broad-spectrum antibiotics to further select for resistant organisms. Rapid antibiotic susceptibility testing (AST) with pathogen identification would transform the care of infected patients while ensuring that the available antibiotic arsenal is deployed as efficiently as possible.

The current gold standard AST assays of measuring growth in the presence of an antibiotic, such as broth microdilution (Wiegand et al.), directly answer the key question of whether the antibiotic inhibits pathogen growth; however, their dependence on serial growth requires 2-3 days from sample collection to results. As an alternative approach, a new generation of assays has emerged to rapidly detect genotypic resistance determinants, yet these are simply proxies for antibiotic resistance in select cases with monogenic determinants (e.g., MRSA Xpert, VRE Xpert, GeneXpert; see Boehme et al., Ioannidis et al., Marlowe et al., Marner et al., and Wolk et al.), or limited to a subset of resistance determinants for a specific drug class (McMullen et al., Smith et al., Traczewski et al., Sullivan et al., Walker et al. *J Clin Microbiol*, Walker et al. *Clin Chem*, and Salimnia et al.). Such approaches fall short of universal AST because of the incomplete knowledge of the innumerable resistance-causing genes and mutations across a wide range of pathogens and antibiotics, and the interactions of these genetic factors with the wide diversity of genomic backgrounds within any given bacterial species (Arzanlou et al.; Cerqueira et al.). Genotypic resistance detection does, however, have the benefit of facilitating molecular epidemiology by allowing specific resistance mechanisms to be identified and tracked (Cerqueira et al.; Woodworth et al.). Whole genome sequencing (WGS) coupled with machine learning has promised the possibility of a more universal genomic approach to AST (Allcock et al.; Bradley et al.; Didelot et al.; Li, Y. et al.; and Nguyen et al.). But while the genomics revolution has undeniably transformed the microbiology field's understanding of antibiotic resistance (Burnham et al.; Gupta, S. K. et al.; Jia et al.; McArthur et al.; and Zankari et al.), as a clinical diagnostic, WGS remains technically demanding, costly, and slow. Moreover, the complexity and variability of bacterial genomes present serious challenges to the ability to predict antibiotic susceptibility with sufficient accuracy to direct patient care (Bhattacharyya et al.; Milheirico et al.; and Ellington et al.). Additionally, the inability to predict the emergence of new resistance mechanisms means that genotypic resistance detection, whether targeted or comprehensive, is fundamentally reactive as new resistance determinants are reported (see e.g., Caniaux et al. 2017; Ford 2018; Garcia-Alvarez et al. 2011; Liakopoulos et al. 2016; Liu et al. 2016; Ma et al. 2018; Paterson et al. 2014; Sun et al. 2018). While certain bacterial species or antibiotic classes are more amenable to genetic resistance prediction (see e.g., Bradley et al. 2015; Consortium et al. 2018), this approach is not readily generalizable (Bhattacharyya et al.; Ellington et al.; Rossen et al.; and Tagini & Greub). These gaps in genetic susceptibility prediction have motivated a number of novel approaches that focus on phenotypic AST but with a more rapid result, including rapid automated microscopy (see e.g., Charnot-Katsikas et al. 2018; Choi et al. 2017; Humphries and Di Martino 2019; Marschal et al. 2017), ultrafine mass measurements (see e.g., Cermak et al. 2016; Longo et al. 2013), and others (see e.g., Barczak et al; Quach et al. 2016; and van Belkum et al. 2017).

Of the current MDROs, carbapenem resistant organisms are the most alarming, as their resistance to this class of broad-spectrum antibiotics often leaves few to no treatment options available (Gupta, N. et al.; Iovleva & Doi et al.; and Nordmann et al. 2012). Yet phenotypic carbapenem resistance detection can be challenging (Lutgring and Limbago 2016; Miller and Humphries 2016), as some carbapenemase-producing strains, even those carrying canonical resistance determinants such as $bla_{KPC}$, may be mistakenly identified as susceptible by current phenotypic assays (Anderson et al. 2007; Arnold et al. 2011; Centers for Disease and Prevention 2009; Chea et al. 2015; Gupta, V. et al. 2018; Nordmann et al. 2009; and Chea et al.) while failing clinical carbapenem therapy (Weisenberg et al. 2009). Rapid genotypic approaches are now available that use multiplexed PCR assays to detect several common carbapenemases in carbapenem-resistant Enterobactericeae (CRE) (see e.g., Evans et al. 2016; Smith et al. 2016; Sullivan et al. 2014). While one advantage of these assays is that they identify the specific mechanism of resistance when present, they fail to identify a significant fraction (13-68%) of CRE isolates with unknown or non-carbapenemase resistance mechanisms (see e.g., Cerqueira et al. 2017; Woodworth et al. 2018; Ye et al. 2018). For non-Enterobacteriaceae, this problem is even more challenging, as unexplained genetic resistance mechanisms account for the vast majority of resistance. For example; just 1.9% of over 1000 carbapenem-resistant *Pseudomonas* in the 2017 CDC survey were found to encode known carbapenemases (see e.g., Woodworth et al. 2018). These challenges have left clinical microbiology laboratories still seeking consensus on how to best apply the multiple possible workflows that currently exist for detecting carbapenem resistance (McMullen et al.; Humphries, R. M.), including phenotypic (CLSI), genetic (McMullen et al., Smith et al., Traczewski et al., Sullivan et al., Walker et al. *J Clin Microbiol*, Walker et al. *Clin Chem*), and biochemical (Humphries, R. M.) assays.

The present disclosure provides a diagnostic approach that has been termed Genotypic and Phenotypic AST through RNA detection (GoPhAST-R), which addresses the above-mentioned prior art problems by detecting both genotype and phenotype in a single assay. Advantageously, this allows for integration of all information while simultaneously providing information about both resistance prediction and molecular epidemiology. mRNA is uniquely informative in this regard, as it encodes genotypic information in its sequence and phenotypic information in its abundance in response to antibiotic exposure. For example, susceptible cells that are stressed upon antibiotic exposure look transcriptionally distinct from resistant cells that are not (Barczak et al. 2012). Leveraging this principle for rapid phenotypic AST built upon multiplexed hybridization-based detection of early transcriptional responses that occur within minutes of antibiotic exposure, the present disclosure defines a phenotypic measure that distinguishes susceptible (by measuring a response in susceptible strains) from resistant organisms, agnostic to the mechanism of resistance. As described in detail below, these techniques are demonstrated for three major antibiotic classes-fluoroquinolones, aminoglycosides, and importantly, carbapenems—in *Klebsiella pneumoniae, Escherichia coli, Acinetobacter baumannii, Pseudomonas aeruginosa*, and *Staphylococcus aureus*, four gram-negative and one gram-positive pathogens that are classified as “critical” or “high priority” threats by the World Health Organization (Tacconelli et al.) and have a propensity for multi-drug resistance through diverse mechanisms that are difficult to determine based solely on genotypic determinants.

The working examples herein describe a generalizable process to extend this approach to any pathogen-antibiotic pair of interest, in certain aspects and without wishing to be bound by theory, the process requires only that an antibiotic elicit a differential transcriptional response in susceptible versus resistant isolates, a biological phenomenon that to date appears to be universal. An analytical framework is described to classify organisms as susceptible or resistant on the basis of 10-transcript signatures detected in a simple multiplexed fluorescent hybridization-based assay on an RNA detection platform (NanoString® nCounter™; Geiss et al.), demonstrating >94-99% categorical agreement with broth microdilution. For carbapenems, a simultaneous genotypic detection of key resistance determinants is incorporated into the same assay to improve accuracy of resistance detection, facilitate molecular epidemiology, and guide antibiotic selection for CRE treatment from among the newer available agents (Lomovskaya et al. 2017; Marshall et al. 2017; van Duin and Bonomo 2016), which has clearly demonstrated the superiority of GoPhAST-R techniques described herein over prior art approaches that measure either genotype or phenotype alone. This important feature shows that several of the discrepant results between GoPhAST-R and broth microdilution occur in carbapenemase-producing strains likely misclassified as susceptible by the gold standard, and correctly classified as resistant by GoPhAST-R. In this regard, the GoPhAST-R techniques described herein can be deployed directly on a positive blood culture bottle with a simple workflow, reporting phenotypic AST within hours of a positive culture, thus 24-36 hours faster than gold standard prior art methods in a head-to-head comparison, yielding AST results with 99% categorical agreement. Finally, GoPhAST-R can determine antibiotic susceptibilities in under 4 hours, using a pilot next-generation RNA detection platform (NanoString® Hyb & Seq™). Together, the techniques herein establish GoPhAST-R as a novel, accurate, rapid approach that can simultaneously report phenotypic and genotypic data and thus leverages the advantages of both approaches.

Treatment Selection

The methods described herein can be used for selecting, and then optionally administering, an optimal treatment (e.g., an antibiotic course) for a subject. Thus the methods described herein include methods for the treatment of bacterial infections. Generally, the methods include administering a therapeutically effective amount of a treatment as described herein, to a subject who is in need of, or who has been determined to be in need of, such treatment.

As used in this context, to “treat” means to ameliorate at least one symptom of the bacterial infection.

An “effective amount” is an amount sufficient to effect beneficial or desired results. For example, a therapeutic amount is one that achieves the desired therapeutic effect (e.g reduction or elimination of a bacterial infection). This amount can be the same or different from a prophylactically effective amount, which is an amount necessary to prevent onset of disease or disease symptoms. An effective amount can be administered in one or more administrations, applications or dosages. A therapeutically effective amount of a therapeutic compound (i.e., an effective dosage) depends on the therapeutic compounds selected. The compositions can be administered from one or more times per day to one or more times per week; including once every other day. The skilled artisan will appreciate that certain factors may influence the dosage and timing required to effectively treat a subject, including but not limited to the severity of the bacterial infection, previous treatments, the general health and/or age of the subject, and other diseases present. Moreover, treatment of a subject with a therapeutically effective amount of the therapeutic compounds described herein can include a single treatment or a series of treatments.

Dosage, toxicity and therapeutic efficacy of the therapeutic compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the disclosure, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

Combination Treatments

The compositions and methods of the present disclosure may be used two direct the administration of combination antibiotic therapies to treat particular bacterial infections. In order to increase the effectiveness of a treatment with the compositions of the present disclosure, e.g., an antibiotic selected and/or administered as a single agent, or to augment the protection of another therapy (second therapy), it may be desirable to combine these compositions and methods with one another, or with other agents and methods effective in the treatment, amelioration, or prevention of diseases and pathologic conditions, for example, an antibiotic infection.

Administration of a composition of the present disclosure to a subject will follow general protocols for the administration described herein, and the general protocols for the administration of a particular secondary therapy will also be followed, taking into account the toxicity, if any, of the treatment. It is expected that the treatment cycles would be repeated as necessary. It also is contemplated that various standard therapies may be applied in combination with the described therapies.

Pharmaceutical Compositions

Agents of the present disclosure can be incorporated into a variety of formulations for therapeutic use (e.g., by administration) or in the manufacture of a medicament (e.g., for treating or preventing a bacterial infection) by combining the agents with appropriate pharmaceutically acceptable carriers or diluents, and may be formulated into preparations in solid, semi-solid, liquid or gaseous forms. Examples of such formulations include, without limitation, tablets, capsules, powders, granules, ointments, solutions, suppositories, injections, inhalants, gels, microspheres, and aerosols.

Pharmaceutical compositions can include, depending on the formulation desired, pharmaceutically-acceptable, non-toxic carriers of diluents, which are vehicles commonly used to formulate pharmaceutical compositions for animal or human administration. The diluent is selected so as not to affect the biological activity of the combination. Examples of such diluents include, without limitation, distilled water, buffered water, physiological saline, PBS, Ringer's solution, dextrose solution, and Hank's solution. A pharmaceutical composition or formulation of the present disclosure can further include other carriers, adjuvants, or non-toxic, non-therapeutic, nonimmunogenic stabilizers, excipients and the like. The compositions can also include additional substances to approximate physiological conditions, such as pH adjusting and buffering agents, toxicity adjusting agents, wetting agents and detergents.

Further examples of formulations that are suitable for various types of administration can be found in Remington's Pharmaceutical Sciences, Mace Publishing Company, Philadelphia, PA, 17th ed. (1985). For a brief review of methods for drug delivery, see, Langer, Science 249:1527-1533 (1990).

For oral administration, the active ingredient can be administered in solid dosage forms, such as capsules, tablets, and powders, or in liquid dosage forms, such as elixirs, syrups, and suspensions. The active component(s) can be encapsulated in gelatin capsules together with inactive ingredients and powdered carriers, such as glucose, lactose, sucrose, mannitol, starch, cellulose or cellulose derivatives, magnesium stearate, stearic acid, sodium saccharin, talcum, magnesium carbonate. Examples of additional inactive ingredients that may be added to provide desirable color, taste, stability, buffering capacity, dispersion or other known desirable features are red iron oxide, silica gel, sodium lauryl sulfate, titanium dioxide, and edible white ink.

Similar diluents can be used to make compressed tablets. Both tablets and capsules can be manufactured as sustained release products to provide for continuous release of medication over a period of hours. Compressed tablets can be sugar coated or film coated to mask any unpleasant taste and protect the tablet from the atmosphere, or enteric-coated for selective disintegration in the gastrointestinal tract. Liquid dosage forms for oral administration can contain coloring and flavoring to increase patient acceptance.

Formulations suitable for parenteral administration include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives.

As used herein, the term "pharmaceutically acceptable salt" refers to those salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts of amines, carboxylic acids, and other types of compounds, are well known in the art. For example, S. M. Berge, et al. describe pharmaceutically acceptable salts in detail in J Pharmaceutical Sciences 66 (1977): 1-19, incorporated herein by reference. The salts can be prepared in situ during the final isolation and purification of the compounds (e.g., FDA-approved compounds) of the application, or separately by reacting a free base or free acid function with a suitable reagent, as described generally below. For example, a free base function can be reacted with a suitable acid. Furthermore, where the compounds to be administered of the application carry an acidic moiety, suitable pharmaceutically acceptable salts thereof may, include metal salts such as alkali metal salts, e.g. sodium or potassium salts; and alkaline earth metal salts, e.g. calcium or magnesium salts. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other methods used in the art such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, loweralkyl sulfonate and aryl sulfonate.

Additionally, as used herein, the term "pharmaceutically acceptable ester" refers to esters that hydrolyze in vivo and include those that break down readily in the human body to leave the parent compound (e.g., an FDA-approved compound where administered to a human subject) or a salt thereof. Suitable ester groups include, for example, those derived from pharmaceutically acceptable aliphatic carboxylic acids, particularly alkanoic, alkenoic, cycloalkanoic and alkanedioic acids, in which each alkyl or alkenyl moeity advantageously has not more than 6 carbon atoms. Examples of particular esters include formates, acetates, propionates, butyrates, acrylates and ethylsuccinates.

Furthermore, the term "pharmaceutically acceptable prodrugs" as used herein refers to those prodrugs of the certain compounds of the present application which are, within the scope of sound medical judgment, suitable for use in contact with the issues of humans and lower animals with undue toxicity, irritation, allergic response, and the like, commensurate with a reasonable benefit/risk ratio, and effective for their intended use, as well as the zwitterionic forms, where possible, of the compounds of the application. The term "prodrug" refers to compounds that are rapidly transformed in vivo to yield the parent compound of an agent of the instant disclosure, for example by hydrolysis in blood. A thorough discussion is provided in T. Higuchi and V. Stella, Pro-drugs as Novel Delivery Systems, Vol. 14 of the A.C.S. Symposium Series, and in Edward B. Roche, ed., Bioreversible Carriers in Drug Design, American Pharmaceutical Association and Pergamon Press, (1987), both of which are incorporated herein by reference.

The components used to formulate the pharmaceutical compositions are preferably of high purity and are substantially free of potentially harmful contaminants (e.g., at least National Food (NF) grade, generally at least analytical grade, and more typically at least pharmaceutical grade). Moreover, compositions intended for in vivo use are usually sterile. To the extent that a given compound must be synthesized prior to use, the resulting product is typically substantially free of any potentially toxic agents, particularly any endotoxins, which may be present during the synthesis or purification process. Compositions for parental administration are also sterile, substantially isotonic and made under GMP conditions.

Formulations may be optimized for retention and stabilization in a subject and/or tissue of a subject, e.g., to prevent rapid clearance of a formulation by the subject. Stabilization techniques include cross-linking, multimerizing, or linking to groups such as polyethylene glycol, polyacrylamide, neutral protein carriers, etc. in order to achieve an increase in molecular weight.

Other strategies for increasing retention include the entrapment of the agent in a biodegradable or bioerodible implant. The rate of release of the therapeutically active agent is controlled by the rate of transport through the polymeric matrix, and the biodegradation of the implant. The transport of drug through the polymer barrier will also be affected by compound solubility, polymer hydrophilicity, extent of polymer cross-linking, expansion of the polymer upon water absorption so as to make the polymer barrier more permeable to the drug, geometry of the implant, and the like. The implants are of dimensions commensurate with the size and shape of the region selected as the site of implantation. Implants may be particles, sheets, patches, plaques, fibers, microcapsules and the like and may be of any size or shape compatible with the selected site of insertion.

The implants may be monolithic, i.e. having the active agent homogenously distributed through the polymeric matrix, or encapsulated, where a reservoir of active agent is encapsulated by the polymeric matrix. The selection of the polymeric composition to be employed will vary with the site of administration, the desired period of treatment, patient tolerance, the nature of the disease to be treated and the like. Characteristics of the polymers will include biodegradability at the site of implantation, compatibility with the agent of interest, ease of encapsulation, a half-life in the physiological environment.

Biodegradable polymeric compositions which may be employed may be organic esters or ethers, which when degraded result in physiologically acceptable degradation products, including the monomers. Anhydrides, amides, orthoesters or the like, by themselves or in combination with other monomers, may find use. The polymers will be condensation polymers. The polymers may be cross-linked or non-cross-linked. Of particular interest are polymers of hydroxyaliphatic carboxylic acids, either homo- or copolymers, and polysaccharides. Included among the polyesters of interest are polymers of D-lactic acid, L-lactic acid, racemic lactic acid, glycolic acid, polycaprolactone, and combinations thereof. By employing the L-lactate or D-lactate, a slowly biodegrading polymer is achieved, while degradation is substantially enhanced with the racemate. Copolymers of glycolic and lactic acid are of particular interest, where the rate of biodegradation is controlled by the ratio of glycolic to lactic acid. The most rapidly degraded copolymer has roughly equal amounts of glycolic and lactic acid, where either homopolymer is more resistant to degradation. The ratio of glycolic acid to lactic acid will also affect the brittleness of in the implant, where a more flexible implant is desirable for larger geometries. Among the polysaccharides of interest are calcium alginate, and functionalized celluloses, particularly carboxymethylcellulose esters characterized by being water insoluble, a molecular weight of about 5 kD to 500 kD, etc. Biodegradable hydrogels may also be employed in the implants of the individual instant disclosure. Hydrogels are typically a copolymer material, characterized by the ability to imbibe a liquid. Exemplary biodegradable hydrogels which may be employed are described in Heller in: Hydrogels in Medicine and Pharmacy, N. A. Peppes ed., Vol. III, CRC Press, Boca Raton, Fla., 1987, pp 137-149.

Pharmaceutical Dosages

Pharmaceutical compositions of the present disclosure containing an agent described herein may be used (e.g., administered to an individual, such as a human individual, in need of treatment with an antibiotic) in accord with known methods, such as oral administration, intravenous administration as a bolus or by continuous infusion over a period of time, by intramuscular, intraperitoneal, intracerobrospinal, intracranial, intraspinal, subcutaneous, intraarticular, intrasynovial, intrathecal, topical, or inhalation routes.

Dosages and desired drug concentration of pharmaceutical compositions of the present disclosure may vary depending on the particular use envisioned. The determination of the appropriate dosage or route of administration is well within the skill of an ordinary artisan. Animal experiments provide reliable guidance for the determination of effective doses for human therapy. Interspecies scaling of effective doses can be performed following the principles described in Mordenti, J. and Chappell, W. "The Use of Interspecies Scaling in Toxicokinetics," In Toxicokinetics and New Drug Development, Yacobi et al., Eds, Pergamon Press, New York 1989, pp. 42-46.

For in vivo administration of any of the agents of the present disclosure, normal dosage amounts may vary from about 10 ng/kg up to about 100 mg/kg of an individual's and/or subject's body weight or more per day, depending upon the route of administration. In some embodiments, the dose amount is about 1 mg/kg/day to 10 mg/kg/day. For repeated administrations over several days or longer, depending on the severity of the disease, disorder, or condition to be treated, the treatment is sustained until a desired suppression of symptoms is achieved.

An effective amount of an agent of the instant disclosure may vary, e.g., from about 0.001 mg/kg to about 1000 mg/kg or more in one or more dose administrations for one or several days (depending on the mode of administration). In certain embodiments, the effective amount per dose varies from about 0.001 mg/kg to about 1000 mg/kg, from about 0.01 mg/kg to about 750 mg/kg, from about 0.1 mg/kg to about 500 mg/kg, from about 1.0 mg/kg to about 250 mg/kg, and from about 10.0 mg/kg to about 150 mg/kg.

An exemplary dosing regimen may include administering an initial dose of an agent of the disclosure of about 200 μg/kg, followed by a weekly maintenance dose of about 100 μg/kg every other week. Other dosage regimens may be useful, depending on the pattern of pharmacokinetic decay that the physician wishes to achieve. For example, dosing an individual from one to twenty-one times a week is contemplated herein. In certain embodiments, dosing ranging from about 3 μg/kg to about 2 mg/kg (such as about 3 μg/kg, about 10 μg/kg, about 30 μg/kg, about 100 μg/kg, about 300 μg/kg, about 1 mg/kg, or about 2 mg/kg) may be used. In certain embodiments, dosing frequency is three times per day, twice per day, once per day, once every other day, once weekly, once every two weeks, once every four weeks, once every five weeks, once every six weeks, once every seven weeks, once every eight weeks, once every nine weeks, once every ten weeks, or once monthly, once every two months, once every three months, or longer. Progress of the therapy is easily monitored by conventional techniques and assays. The dosing regimen, including the agent(s) administered, can vary over time independently of the dose used.

Pharmaceutical compositions described herein can be prepared by any method known in the art of pharmacology. In general, such preparatory methods include the steps of bringing the agent or compound described herein (i.e., the "active ingredient") into association with a carrier or excipient, and/or one or more other accessory ingredients, and then, if necessary and/or desirable, shaping, and/or packaging the product into a desired single- or multi-dose unit.

Pharmaceutical compositions can be prepared, packaged, and/or sold in bulk, as a single unit dose, and/or as a plurality of single unit doses. A "unit dose" is a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition described herein will vary, depending upon the identity, size, and/or condition of the subject treated and further depending upon the route by which the composition is to be administered. The composition may comprise between 0.1% and 100% (w/w) active ingredient.

Pharmaceutically acceptable excipients used in the manufacture of provided pharmaceutical compositions include inert diluents, dispersing and/or granulating agents, surface active agents and/or emulsifiers, disintegrating agents, binding agents, preservatives, buffering agents, lubricating agents, and/or oils. Excipients such as cocoa butter and suppository waxes, coloring agents, coating agents, sweetening, flavoring, and perfuming agents may also be present in the composition.

Exemplary diluents include calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, and mixtures thereof.

Exemplary granulating and/or dispersing agents include potato starch, corn starch, tapioca starch, sodium starch glycolate, clays, alginic acid, guar gum, citrus pulp, agar, bentonite, cellulose, and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (Veegum), sodium lauryl sulfate, quaternary ammonium compounds, and mixtures thereof.

Exemplary surface active agents and/or emulsifiers include natural emulsifiers (e.g., acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g., bentonite (aluminum silicate) and Veegum (magnesium aluminum silicate)), long chain amino acid derivatives, high molecular weight alcohols (e.g., stearyl alcohol, cetyl alcohol, oleyl alcohol, triacetin monostearate, ethylene glycol distearate, glyceryl monostearate, and propylene glycol monostearate, polyvinyl alcohol), carbomers (e.g., carboxy polymethylene, polyacrylic acid, acrylic acid polymer, and carboxyvinyl polymer), carrageenan, cellulosic derivatives (e.g., carboxymethylcellulose sodium, powdered cellulose, hydroxymethyl cellulose, hydroxypropyl cellulose, hydroxypropyl methylcellulose, methylcellulose), sorbitan fatty acid esters (e.g., polyoxyethylene sorbitan monolaurate (Tween® 20), polyoxyethylene sorbitan (Tween® 60), polyoxyethylene sorbitan monooleate (Tween® 80), sorbitan monopalmitate (Span® 40), sorbitan monostearate (Span® 60), sorbitan tristearate (Span® 65), glyceryl monooleate, sorbitan monooleate (Span® 80), polyoxyethylene esters (e.g., polyoxyethylene monostearate (Myrj® 45), polyoxyethylene hydrogenated castor oil, polyethoxylated castor oil, polyoxymethylene stearate, and Solutol®) sucrose fatty acid esters, polyethylene glycol fatty acid esters (e.g., Cremophor®), polyoxyethylene ethers, (e.g., polyoxyethylene lauryl ether (Brij® 30)), poly(vinyl-pyrrolidone), diethylene glycol monolaurate, triethanolamine oleate, sodium oleate, potassium oleate, ethyl oleate, oleic acid, ethyl laurate, sodium lauryl sulfate, Pluronic® F-68, Poloxamer P-188, cetrimonium bromide, cetylpyridinium chloride, benzalkonium chloride, docusate sodium, and/or mixtures thereof.

Exemplary binding agents include starch (e.g., cornstarch and starch paste), gelatin, sugars (e.g., sucrose, glucose, dextrose, dextrin, molasses, lactose, lactitol, mannitol, etc.), natural and synthetic gums (e.g., acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (Veegum®), and larch arabogalactan), alginates, polyethylene oxide, polyethylene glycol, inorganic calcium salts, silicic acid, polymethacrylates, waxes, water, alcohol, and/or mixtures thereof.

Exemplary preservatives include antioxidants, chelating agents, antimicrobial preservatives, antifungal preservatives, antiprotozoan preservatives, alcohol preservatives, acidic preservatives, and other preservatives. In certain embodiments, the preservative is an antioxidant. In other embodiments, the preservative is a chelating agent.

Exemplary antioxidants include alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and sodium sulfite.

Exemplary chelating agents include ethylenediaminetetraacetic acid (EDTA) and salts and hydrates thereof (e.g., sodium edetate, disodium edetate, trisodium edetate, calcium disodium edetate, dipotassium edetate, and the like), citric acid and salts and hydrates thereof (e.g., citric acid monohydrate), fumaric acid and salts and hydrates thereof, malic acid and salts and hydrates thereof, phosphoric acid and salts and hydrates thereof, and tartaric acid and salts and hydrates thereof. Exemplary antimicrobial preservatives include benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and thimerosal.

Exemplary antifungal preservatives include butyl paraben, methyl paraben, ethyl paraben, propyl paraben, benzoic acid, hydroxybenzoic acid, potassium benzoate, potassium sorbate, sodium benzoate, sodium propionate, and sorbic acid.

Exemplary alcohol preservatives include ethanol, polyethylene glycol, phenol, phenolic compounds, bisphenol, chlorobutanol, hydroxybenzoate, and phenylethyl alcohol.

Exemplary acidic preservatives include vitamin A, vitamin C, vitamin E, beta-carotene, citric acid, acetic acid, dehydroacetic acid, ascorbic acid, sorbic acid, and phytic acid.

Other preservatives include tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, Glydant® Plus, Phenonip®, methylparaben, Germall® 115, Germaben® II, Neolone®, Kathon®, and Euxyl®.

Exemplary buffering agents include citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, and mixtures thereof.

Exemplary lubricating agents include magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, and mixtures thereof.

Exemplary natural oils include almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary synthetic oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and mixtures thereof.

Liquid dosage forms for oral and parenteral administration include pharmaceutically acceptable emulsions, microemulsions, solutions, suspensions, syrups and elixirs. In addition to the active ingredients, the liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (e.g., cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, the oral compositions can include adjuvants such as wetting agents, emulsifying and suspending agents, sweetening, flavoring, and perfuming agents. In certain embodiments for parenteral administration, the conjugates described herein are mixed with solubilizing agents such as Cremophor®, alcohols, oils, modified oils, glycols, polysorbates, cyclodextrins, polymers, and mixtures thereof.

Injectable preparations, for example, sterile injectable aqueous or oleaginous suspensions can be formulated according to the known art using suitable dispersing or wetting agents and suspending agents. The sterile injectable preparation can be a sterile injectable solution, suspension, or emulsion in a nontoxic parenterally acceptable diluent or solvent, for example, as a solution in 1,3-butanediol. Among the acceptable vehicles and solvents that can be employed are water, Ringer's solution, U.S.P., and isotonic sodium chloride solution. In addition, sterile, fixed oils are conventionally employed as a solvent or suspending medium. For this purpose any bland fixed oil can be employed including synthetic mono- or di-glycerides. In addition, fatty acids such as oleic acid are used in the preparation of injectables.

The injectable formulations can be sterilized, for example, by filtration through a bacterial-retaining filter, or by incorporating sterilizing agents in the form of sterile solid compositions which can be dissolved or dispersed in sterile water or other sterile injectable medium prior to use.

In order to prolong the effect of a drug, it is often desirable to slow the absorption of the drug from subcutaneous or intramuscular injection. This can be accomplished by the use of a liquid suspension of crystalline or amorphous material with poor water solubility. The rate of absorption of the drug then depends upon its rate of dissolution, which, in turn, may depend upon crystal size and crystalline form. Alternatively, delayed absorption of a parenterally administered drug form may be accomplished by dissolving or suspending the drug in an oil vehicle.

Compositions for rectal or vaginal administration are typically suppositories which can be prepared by mixing the conjugates described herein with suitable non-irritating excipients or carriers such as cocoa butter, polyethylene glycol, or a suppository wax which are solid at ambient temperature but liquid at body temperature and therefore melt in the rectum or vaginal cavity and release the active ingredient.

Solid dosage forms for oral administration include capsules, tablets, pills, powders, and granules. In such solid dosage forms, the active ingredient is mixed with at least one inert, pharmaceutically acceptable excipient or carrier such as sodium citrate or dicalcium phosphate and/or (a) fillers or extenders such as starches, lactose, sucrose, glucose, mannitol, and silicic acid, (b) binders such as, for example, carboxymethylcellulose, alginates, gelatin, polyvinylpyrrolidinone, sucrose, and acacia, (c) humectants such as glycerol, (d) disintegrating agents such as agar, calcium carbonate, potato or tapioca starch, alginic acid, certain silicates, and sodium carbonate, (e) solution retarding agents such as paraffin, (f) absorption accelerators such as quaternary ammonium compounds, (g) wetting agents such as, for example, cetyl alcohol and glycerol monostearate, (h) absorbents such as kaolin and bentonite clay, and (i) lubricants such as talc, calcium stearate, magnesium stearate, solid polyethylene glycols, sodium lauryl sulfate, and mixtures thereof. In the case of capsules, tablets, and pills, the dosage form may include a buffering agent.

Solid compositions of a similar type can be employed as fillers in soft and hard-filled gelatin capsules using such excipients as lactose or milk sugar as well as high molecular weight polyethylene glycols and the like. The solid dosage forms of tablets, dragees, capsules, pills, and granules can be prepared with coatings and shells such as enteric coatings and other coatings well known in the art of pharmacology. They may optionally comprise opacifying agents and can be of a composition that they release the active ingredient(s) only, or preferentially, in a certain part of the intestinal tract, optionally, in a delayed manner. Examples of encapsulating compositions which can be used include polymeric substances and waxes. Solid compositions of a similar type can be employed as fillers in soft and hard-filled gelatin capsules using such excipients as lactose or milk sugar as well as high molecular weight polyethylene glycols and the like.

The active ingredient can be in a micro-encapsulated form with one or more excipients as noted above. The solid dosage forms of tablets, dragees, capsules, pills, and granules can be prepared with coatings and shells such as enteric coatings, release controlling coatings, and other coatings well known in the pharmaceutical formulating art. In such solid dosage forms the active ingredient can be admixed with at least one inert diluent such as sucrose, lactose, or starch. Such dosage forms may comprise, as is normal practice, additional substances other than inert diluents, e.g., tableting lubricants and other tableting aids such a magnesium stearate and microcrystalline cellulose. In the case of capsules, tablets and pills, the dosage forms may comprise buffering agents. They may optionally comprise opacifying agents and can be of a composition that they release the active ingredient(s) only, or preferentially, in a certain part of the intestinal tract, optionally, in a delayed manner. Examples of encapsulating agents which can be used include polymeric substances and waxes.

Dosage forms for topical and/or transdermal administration of an agent (e.g., an antibiotic) described herein may include ointments, pastes, creams, lotions, gels, powders, solutions, sprays, inhalants, and/or patches. Generally, the active ingredient is admixed under sterile conditions with a pharmaceutically acceptable carrier or excipient and/or any needed preservatives and/or buffers as can be required. Additionally, the present disclosure contemplates the use of transdermal patches, which often have the added advantage of providing controlled delivery of an active ingredient to the body. Such dosage forms can be prepared, for example, by dissolving and/or dispensing the active ingredient in the proper medium. Alternatively or additionally, the rate can be controlled by either providing a rate controlling membrane and/or by dispersing the active ingredient in a polymer matrix and/or gel.

Suitable devices for use in delivering intradermal pharmaceutical compositions described herein include short needle devices. Intradermal compositions can be administered by devices which limit the effective penetration length of a needle into the skin. Alternatively or additionally, conventional syringes can be used in the classical mantoux method of intradermal administration. Jet injection devices which deliver liquid formulations to the dermis via a liquid jet injector and/or via a needle which pierces the stratum corneum and produces a jet which reaches the dermis are suitable. Ballistic powder/particle delivery devices which use compressed gas to accelerate the compound in powder form through the outer layers of the skin to the dermis are suitable.

Formulations suitable for topical administration include, but are not limited to, liquid and/or semi-liquid preparations such as liniments, lotions, oil-in-water and/or water-in-oil emulsions such as creams, ointments, and/or pastes, and/or solutions and/or suspensions. Topically administrable formulations may, for example, comprise from about 1% to about 10% (w/w) active ingredient, although the concentration of the active ingredient can be as high as the solubility limit of the active ingredient in the solvent. Formulations for topical administration may further comprise one or more of the additional ingredients described herein.

A pharmaceutical composition described herein can be prepared, packaged, and/or sold in a formulation suitable for pulmonary administration via the buccal cavity. Such a formulation may comprise dry particles which comprise the active ingredient and which have a diameter in the range from about 0.5 to about 7 nanometers, or from about 1 to about 6 nanometers. Such compositions are conveniently in the form of dry powders for administration using a device comprising a dry powder reservoir to which a stream of propellant can be directed to disperse the powder and/or using a self-propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nanometers and at least 95% of the particles by number have a diameter less than 7 nanometers. Alternatively, at least 95% of the particles by weight have a diameter greater than 1 nanometer and at least 90% of the particles by number have a diameter less than 6 nanometers. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50 to 99.9% (w/w) of the composition, and the active ingredient may constitute 0.1 to 20% (w/w) of the composition. The propellant may further comprise additional ingredients such as a liquid non-ionic and/or solid anionic surfactant and/or a solid diluent (which may have a particle size of the same order as particles comprising the active ingredient).

Pharmaceutical compositions described herein formulated for pulmonary delivery may provide the active ingredient in the form of droplets of a solution and/or suspension. Such formulations can be prepared, packaged, and/or sold as aqueous and/or dilute alcoholic solutions and/or suspensions, optionally sterile, comprising the active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. The droplets provided by this route of administration may have an average diameter in the range from about 0.1 to about 200 nanometers.

Formulations described herein as being useful for pulmonary delivery are useful for intranasal delivery of a pharmaceutical composition described herein. Another formulation suitable for intranasal administration is a coarse powder comprising the active ingredient and having an average particle from about 0.2 to 500 micrometers. Such a formulation is administered by rapid inhalation through the nasal passage from a container of the powder held close to the nares.

Formulations for nasal administration may, for example, comprise from about as little as 0.1% (w/w) to as much as 100% (w/w) of the active ingredient, and may comprise one or more of the additional ingredients described herein. A pharmaceutical composition described herein can be prepared, packaged, and/or sold in a formulation for buccal administration. Such formulations may, for example, be in the form of tablets and/or lozenges made using conventional methods, and may contain, for example, 0.1 to 20% (w/w) active ingredient, the balance comprising an orally dissolvable and/or degradable composition and, optionally, one or more of the additional ingredients described herein. Alternately, formulations for buccal administration may comprise a powder and/or an aerosolized and/or atomized solution and/or suspension comprising the active ingredient. Such powdered, aerosolized, and/or aerosolized formulations, when dispersed, may have an average particle and/or droplet size in the range from about 0.1 to about 200 nanometers, and may further comprise one or more of the additional ingredients described herein.

A pharmaceutical composition described herein can be prepared, packaged, and/or sold in a formulation for ophthalmic administration. Such formulations may, for example, be in the form of eye drops including, for example, a 0.1-1.0% (w/w) solution and/or suspension of the active ingredient in an aqueous or oily liquid carrier or excipient. Such drops may further comprise buffering agents, salts, and/or one or more other of the additional ingredients described herein. Other ophthalmically-administrable formulations which are useful include those which comprise the active ingredient in microcrystalline form and/or in a liposomal preparation. Ear drops and/or eye drops are also contemplated as being within the scope of this disclosure.

Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with ordinary experimentation.

FDA-approved drugs provided herein are typically formulated in dosage unit form for ease of administration and uniformity of dosage. It will be understood, however, that the total daily usage of the agents described herein will be decided by a physician within the scope of sound medical judgment. The specific therapeutically effective dose level for any particular subject or organism will depend upon a variety of factors including the disease being treated and the severity of the disorder; the activity of the specific active ingredient employed; the specific composition employed; the age, body weight, general health, sex, and diet of the subject; the time of administration, route of administration, and rate of excretion of the specific active ingredient employed; the duration of the treatment; drugs used in combination or coincidental with the specific active ingredient employed; and like factors well known in the medical arts.

The agents and compositions provided herein can be administered by any route, including enteral (e.g., oral), parenteral, intravenous, intramuscular, intra-arterial, intramedullary, intrathecal, subcutaneous, intraventricular, transdermal, interdermal, rectal, intravaginal, intraperitoneal, topical (as by powders, ointments, creams, and/or drops), mucosal, nasal, bucal, sublingual; by intratracheal instillation, bronchial instillation, and/or inhalation; and/or as an oral spray, nasal spray, and/or aerosol. Specifically contemplated routes are oral administration, intravenous administration (e.g., systemic intravenous injection), regional administration via blood and/or lymph supply, and/or direct administration to an affected site. In general, the most appropriate route of administration will depend upon a variety of factors including the nature of the agent (e.g., its stability in the environment of the gastrointestinal tract), and/or the condition of the subject (e.g., whether the subject is able to tolerate oral administration). In certain embodiments, the agent or pharmaceutical composition described herein is suitable for topical administration to the eye of a subject.

The exact amount of an agent required to achieve an effective amount will vary from subject to subject, depending, for example, on species, age, and general condition of a subject, severity of the side effects or disorder, identity of the particular agent, mode of administration, and the like. An effective amount may be included in a single dose (e.g., single oral dose) or multiple doses (e.g., multiple oral doses). In certain embodiments, when multiple doses are administered to a subject or applied to a tissue or cell, any two doses of the multiple doses include different or substantially the same amounts of an agent (e.g., an antibiotic) described herein.

As noted elsewhere herein, a drug of the instant disclosure may be administered via a number of routes of administration, including but not limited to: subcutaneous, intravenous, intrathecal, intramuscular, intranasal, oral, transepidermal, parenteral, by inhalation, or intracerebroventricular.

The term "injection" or "injectable" as used herein refers to a bolus injection (administration of a discrete amount of an agent for raising its concentration in a bodily fluid), slow bolus injection over several minutes, or prolonged infusion, or several consecutive injections/infusions that are given at spaced apart intervals.

In some embodiments of the present disclosure, a formulation as herein defined is administered to the subject by bolus administration.

The FDA-approved drug or other therapy is administered to the subject in an amount sufficient to achieve a desired effect at a desired site (e.g., reduction of cancer size, cancer cell abundance, symptoms, etc.) determined by a skilled clinician to be effective. In some embodiments of the disclosure, the agent is administered at least once a year. In other embodiments of the disclosure, the agent is administered at least once a day. In other embodiments of the disclosure, the agent is administered at least once a week. In some embodiments of the disclosure, the agent is administered at least once a month.

Additional exemplary doses for administration of an agent of the disclosure to a subject include, but are not limited to, the following: 1-20 mg/kg/day, 2-15 mg/kg/day, 5-12 mg/kg/day, 10 mg/kg/day, 1-500 mg/kg/day, 2-250 mg/kg/day, 5-150 mg/kg/day, 20-125 mg/kg/day, 50-120 mg/kg/day, 100 mg/kg/day, at least 10 μg/kg/day, at least 100 μg/kg/day, at least 250 μg/kg/day, at least 500 μg/kg/day, at least 1 mg/kg/day, at least 2 mg/kg/day, at least 5 mg/kg/day, at least 10 mg/kg/day, at least 20 mg/kg/day, at least 50 mg/kg/day, at least 75 mg/kg/day, at least 100 mg/kg/day, at least 200 mg/kg/day, at least 500 mg/kg/day, at least 1 g/kg/day, and a therapeutically effective dose that is less than 500 mg/kg/day, less than 200 mg/kg/day, less than 100 mg/kg/day, less than 50 mg/kg/day, less than 20 mg/kg/day, less than 10 mg/kg/day, less than 5 mg/kg/day, less than 2 mg/kg/day, less than 1 mg/kg/day, less than 500 μg/kg/day, and less than 500 μg/kg/day.

In certain embodiments, when multiple doses are administered to a subject or applied to a tissue or cell, the frequency of administering the multiple doses to the subject or applying the multiple doses to the tissue or cell is three doses a day, two doses a day, one dose a day, one dose every other day, one dose every third day, one dose every week, one dose every two weeks, one dose every three weeks, or one dose every four weeks. In certain embodiments, the frequency of administering the multiple doses to the subject or applying the multiple doses to the tissue or cell is one dose per day. In certain embodiments, the frequency of administering the multiple doses to the subject or applying the multiple doses to the tissue or cell is two doses per day. In certain embodiments, the frequency of administering the multiple doses to the subject or applying the multiple doses to the tissue or cell is three doses per day. In certain embodiments, when multiple doses are administered to a subject or applied to a tissue or cell, the duration between the first dose and last dose of the multiple doses is one day, two days, four days, one week, two weeks, three weeks, one month, two months, three months, four months, six months, nine months, one year, two years, three years, four years, five years, seven years, ten years, fifteen years, twenty years, or the lifetime of the subject, tissue, or cell. In certain embodiments, the duration between the first dose and last dose of the multiple doses is three months, six months, or one year. In certain embodiments, the duration between the first dose and last dose of the multiple doses is the lifetime of the subject, tissue, or cell. In certain embodiments, a dose (e.g., a single dose, or any dose of multiple doses) described herein includes independently between 0.1 μg and 1 μg, between 0.001 mg and 0.01 mg, between 0.01 mg and 0.1 mg, between 0.1 mg and 1 mg, between 1 mg and 3 mg, between 3 mg and 10 mg, between 10 mg and 30 mg, between 30 mg and 100 mg, between 100 mg and 300 mg, between 300 mg and 1,000 mg, or between 1 g and 10 g, inclusive, of an agent (e.g., an antibiotic) described herein. In certain embodiments, a dose described herein includes independently between 1 mg and 3 mg, inclusive, of an agent (e.g., an antibiotic) described herein. In certain embodiments, a dose described herein includes independently between 3 mg and 10 mg, inclusive, of an agent (e.g., an antibiotic) described herein. In certain embodiments, a dose described herein includes independently between 10 mg and 30 mg, inclusive, of an agent (e.g., an antibiotic) described herein. In certain embodiments, a dose described herein includes independently between 30 mg and 100 mg, inclusive, of an agent (e.g., an antibiotic) described herein.

It will be appreciated that dose ranges as described herein provide guidance for the administration of provided pharmaceutical compositions to an adult. The amount to be administered to, for example, a child or an adolescent can be determined by a medical practitioner or person skilled in the art and can be lower or the same as that administered to an adult. In certain embodiments, a dose described herein is a dose to an adult human whose body weight is 70 kg.

It will be also appreciated that an agent (e.g., an antibiotic) or composition, as described herein, can be administered in combination with one or more additional pharmaceutical agents (e.g., therapeutically and/or prophylactically active agents), which are different from the agent or composition and may be useful as, e.g., combination therapies. The agents or compositions can be administered in combination with additional pharmaceutical agents that improve their activity (e.g., activity (e.g., potency and/or efficacy) in treating a disease in a subject in need thereof, in preventing a disease in a subject in need thereof, in reducing the risk of developing a disease in a subject in need thereof, in inhibiting the replication of a virus, in killing a virus, etc. in a subject or cell. In certain embodiments, a pharmaceutical composition described herein including an agent (e.g., an antibiotic) described herein and an additional pharmaceutical agent shows a synergistic effect that is absent in a pharmaceutical composition including one of the agent and the additional pharmaceutical agent, but not both.

In some embodiments of the disclosure, a therapeutic agent distinct from a first therapeutic agent of the disclosure is administered prior to, in combination with, at the same time, or after administration of the agent of the disclosure. In some embodiments, the second therapeutic agent is selected from the group consisting of a chemotherapeutic, an antioxidant, an anti-inflammatory agent, an antimicrobial, a steroid, etc.

The agent or composition can be administered concurrently with, prior to, or subsequent to one or more additional pharmaceutical agents, which may be useful as, e.g., combination therapies. Pharmaceutical agents include therapeutically active agents. Pharmaceutical agents also include prophylactically active agents. Pharmaceutical agents include small organic molecules such as drug compounds (e.g., compounds approved for human or veterinary use by the U.S. Food and Drug Administration as provided in the Code of Federal Regulations (CFR)), peptides, proteins, carbohydrates, monosaccharides, oligosaccharides, polysaccharides, nucleoproteins, mucoproteins, lipoproteins, synthetic polypeptides or proteins, small molecules linked to proteins, glycoproteins, steroids, nucleic acids, DNAs, RNAs, nucleotides, nucleosides, oligonucleotides, antisense oligonucleotides, lipids, hormones, vitamins, and cells. In certain embodiments, the additional pharmaceutical agent is a pharmaceutical agent useful for treating and/or preventing a disease described herein. Each additional pharmaceutical agent may be administered at a dose and/or on a time schedule determined for that pharmaceutical agent. The additional pharmaceutical agents may also be administered together with each other and/or with the agent or composition described herein in a single dose or administered separately in different doses. The particular combination to employ in a regimen will take into account compatibility of the agent described herein with the additional pharmaceutical agent(s) and/or the desired therapeutic and/or prophylactic effect to be achieved. In general, it is expected that the additional pharmaceutical agent(s) in combination be utilized at levels that do not exceed the levels at which they are utilized individually. In some embodiments, the levels utilized in combination will be lower than those utilized individually.

Dosages for a particular agent of the instant disclosure may be determined empirically in individuals who have been given one or more administrations of the agent.

Administration of an agent of the present disclosure can be continuous or intermittent, depending, for example, on the recipient's physiological condition, whether the purpose of the administration is therapeutic or prophylactic, and other factors known to skilled practitioners. The administration of an agent may be essentially continuous over a preselected period of time or may be in a series of spaced doses.

Guidance regarding particular dosages and methods of delivery is provided in the literature; see, for example, U.S. Pat. Nos. 4,657,760; 5,206,344; or 5,225,212. It is within the scope of the instant disclosure that different formulations will be effective for different treatments and different disorders, and that administration intended to treat a specific organ or tissue may necessitate delivery in a manner different from that to another organ or tissue. Moreover, dosages may be administered by one or more separate administrations, or by continuous infusion. For repeated administrations over several days or longer, depending on the condition, the treatment is sustained until a desired suppression of disease symptoms occurs. However, other dosage regimens may be useful. The progress of this therapy is easily monitored by conventional techniques and assays.

Kits

The instant disclosure also provides kits containing agents of this disclosure for use in the methods of the present disclosure. Kits of the instant disclosure may include one or more containers comprising an agent (e.g., a sample preparation reagent) of this disclosure and/or may contain agents (e.g., oligonucleotide primers, probes, and one or more detectable probes or probe sets etc.) for identifying a cancer or subject as possessing one or more variant sequences. In some embodiments, the kits further include instructions for use in accordance with the methods of this disclosure. In some embodiments, these instructions comprise a description of sample preparation and target binding/signal detection protocol. In some embodiments, the instructions comprise a description of how to detect antibiotic susceptibility and direct therapeutic intervention accordingly.

The instructions generally include information as to dosage, dosing schedule, and route of administration for the intended treatment. The containers may be unit doses, bulk packages (e.g., multi-dose packages) or sub-unit doses. Instructions supplied in the kits of the instant disclosure are typically written instructions on a label or package insert (e.g., a paper sheet included in the kit), but machine-readable instructions (e.g., instructions carried on a magnetic or optical storage disk) are also acceptable.

The label or package insert indicates that the composition is used for treating, e.g., a class bacterial infections, in a subject. Instructions may be provided for practicing any of the methods described herein.

The kits of this disclosure are in suitable packaging. Suitable packaging includes, but is not limited to, vials, bottles, jars, flexible packaging (e.g., sealed Mylar or plastic bags), and the like. In certain embodiments, at least one active agent in the composition is one or more by apartheid probe sets designed for detecting specific mRNAs or mRNA signature profiles. The container may further comprise a second pharmaceutically active agent.

Kits may optionally provide additional components such as buffers and interpretive information. Normally, the kit comprises a container and a label or package insert(s) on or associated with the container.

The practice of the present disclosure employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this disclosure belongs.

Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Reference will now be made in detail to exemplary embodiments of the disclosure. While the disclosure will be described in conjunction with the exemplary embodiments, it will be understood that it is not intended to limit the disclosure to those embodiments. To the contrary, it is intended to cover alternatives, modifications, and equivalents as may be included within the spirit and scope of the disclosure as defined by the appended claims. Standard techniques well known in the art or the techniques specifically described below were utilized.

EXAMPLES

Example 1: Rapid Phenotypic Detection of Antibiotic Resistance

The techniques herein allow for rapid phenotypic detection of antibiotic resistance, faster than growth-based phenotypic assays that currently comprise the gold standard. Advantageously, the techniques herein provide compositions and methods that allow simultaneous detection of multiple resistance genes in the same assay. Additionally, the techniques herein provide more accurate determination of resistance, as well as mechanistic explanations for key antibiotic resistant strains, epidemiologic tracking of known resistance mechanisms, and immediate identification of unknown or potentially novel resistance mechanisms (e.g., discordant cases when a resistant organism does not display a known resistance phenotype). Currently, detection of antibiotic resistance genes typically requires separate PCR or sequencing assays, which require different assay infrastructure and often necessitate sending samples out to reference laboratories.

The phenotypic antibiotic susceptibility testing (AST) portion of the techniques herein relies on quantitative measurement of the most antibiotic-responsive transcripts in a microbial pathogen upon antibiotic exposure. According to the techniques herein, RNA-Seq may be used to identify antibiotic responsive genes that change the most in susceptible, but not resistant, bacterial strains in response to exposure to an antibiotic. In this way, the nucleic acid targets for use in AST may be identified.

Figure 1B:
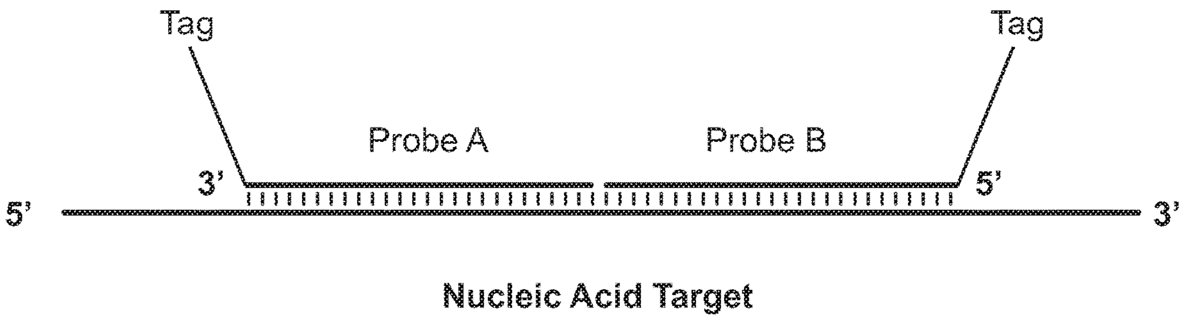
Figure 1C:
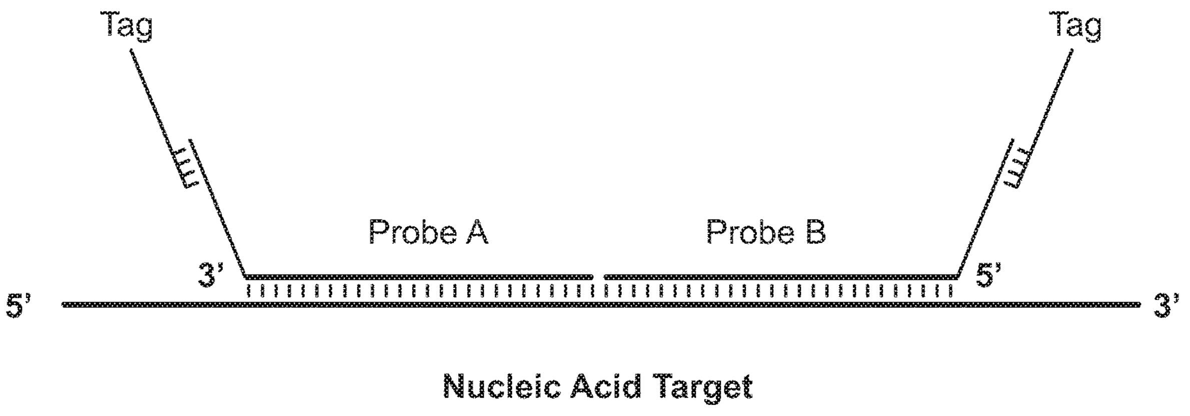

Once antibiotic responsive nucleic acid targets are identified, they can be assayed with target specific probes or sets of probes. According to the techniques herein, target specific probes may include bipartite probes (e.g., Probe A and Probe B) as shown in FIG. 1A. In embodiments, each such probe may range in length from about 15-100, 25-75, 30-70, 40-60, or 45-55 nucleotides in length. In embodiments, each such probe may be about 50 nucleotides in length. As shown in FIG. 1A, Probe A and Probe B are oriented in a tail to head configuration (e.g., 3' end of Probe B is positioned proximate to 5' end of Probe A). In embodiments, 3' end of Probe B abuts the 5' and of Probe A; however, it is contemplated within the scope of the disclosure that a gap of about 1-50 nucleotides may occur between 3' end of Probe B and 5' end of Probe A. As shown in FIGS. 1B-1C, bipartite probes according to the techniques herein may be detected via directly coupled tags or indirectly coupled tags, respectively.

Current assay conditions: hybridization of the bipartite probe sets at 65-67° C. for 1 hour, then detection on a NanoString® Sprint instrument. Briefly, 3 μl of crude lysate is incubated with unlabeled probe pairs (e.g. probe sets) for each target along with labeled NanoString® Elements TagSet reagents. Standard hybridization conditions according to the manufacturer's protocol are followed, except hybridizations are incubated for one hour at 67° C. instead of the recommended 16-24 hours. Hybridizations are then loaded and processed on a Sprint instrument (NanoString®) for purification and quantitative detection. These methods have been validated on: bacteria in pure culture; clinical urine samples; clinical blood culture samples.

Example 2: Genetic Basis for Carbapenem Resistance

To test and validate the techniques described herein, the genetic basis for carbapenem resistance, carbapenemases, was assessed by identifying and measuring the most important, transmissible cause of resistance to this last-line antibiotic. The techniques herein allowed antibiotic-responsive transcripts to be detected quantitatively, and in a multiplexed fashion in a single assay from crude lysate, which enhanced the speed of detection while minimizing sample processing/manipulation. The techniques herein were conducted on the NanoString® assay platform; however, one of skill in the art will readily comprehend that these techniques are not dependent on a single detection platform and may be conducted on any of a variety of detection platforms for quantitative RNA measurement (e.g., NanoString®, SHERLOCK, qRT-PCR, microarrays, etc.) capable of providing the above features.

The analysis herein identified seventeen relevant target sequences to be targeted by the Cre2 probe targets (e.g., probeset), which are shown in Table 1.

TABLE 1

Cre2 Target Sequences
CRE2 Probe Targets:

| Target: | target sequence in gene |
|---|---|
| ST258_wzi_1 (SEQ ID NO: 35) | ACCAGTCAATAAATAAAGCGTTCCCTCATGCCGATACTCTGAAAGGTGTTCAGCTGGGATGGAGTGGGAATGTTTATCAGTCGGTTCGAATTAACACTTC |
| ST258_wzy_1 (SEQ ID NO: 36) | AAAAAACTAATCTATATATTGCTAATACCAATTGCAGGCTTAGCAGTTTTTGCAATTTTTCAGGAGAGGCTGTCGCATGATGGTTATACATCATATGAAC |
| ST58_wzi_2 (SEQ ID NO: 37) | AAACCTTCCTATTCCTCTGAGCAGGTAGTTCTGGCTCGTATCAATCAGCGACTGTCAGCGTTAAAAGCCGATTTCCGGGTCACCGGCTATACCTCGACCG |
| ST258_wzy_2 (SEQ ID NO: 38) | GCCAACATTTATCAGCTATAAAGCGCAACTTTACTTTGACCTGAATACGGAAGGAGACCTTAAAAGAGTTACAGCAGTTGCAATGGGATTTGGAAGTCTT |
| CRE2_KPC_0.95 (SEQ ID NO: 39) | ACCCATCTCGGAAAAATATCTGACAACAGGCATGACGGTGGCGGAGCTGTCCGCGGCCGCCGTGCAATACAGTGATAACGCCGCCGCCAATTTGTTGCTG |
| CRE2_NDM_0.95 (SEQ ID NO: 40) | CAAATGGAAACTGGCGACCAACGGTTTGGCGATCTGGTTTTCCGCCAGCTCGCACCGAATGTCTGGCAGCACACTTCCTATCTCGACATGCCGGGTTTCG |
| CRE2_OXA48_0.95 (SEQ ID NO: 41) | TGCTACATGCTTTCGATTATGGTAATGAGGACATTTCGGGCAATGTAGACAGTTTCTGGCTCGACGGTGGTATTCGAATTTCGGCCACGGAGCAAATCAG |
| CRE2_CTXM15_0.95 (SEQ ID NO: 42) | AGTGAAAGCGAACCGAATCTGTTAAATCAGCGAGTTGAGATCAAAAAATCTGACCTTGTTAACTATAATCCGATTGCGGAAAAGCACGTCAATGGGACGA |
| CRE2_IMP_1_0.95 (SEQ ID NO: 43) | GAAGAAGGTGTTTATGTTCATACATCGTTCGAAGAAGTTAACGGTTGGGGTGTTGTTTCTAAACACGGTTTGGTGGTTCTTGTAAACACTGACGCCTATC |
| CRE2_IMP_3_8_0.95 (SEQ ID NO: 44) | GTTTTTTATCCCGGCCCGGGGCACACTCAAGATAACGTAGTGGTTTGGTTACCTGAAAAGAAAATTTTATTCGGTGGTTGTTTTGTTAAACCGGACGGTC |
| CRE2_IMP_2_4_0.95 (SEQ ID NO: 45) | GAAAAGTTAGTCAATTGGTTTGTGGAGCGCGGCTATAAAATCAAAGGCACTATTTCCTCACATTTCCATAGCGACAGCACAGGGGGAATAGAGTGGCTTA |
| CRE2_IMP_5_0.95 (SEQ ID NO: 46) | AAGTATGGTAATGCAAAACTGGTTGTTTCGAGTCATAGTGAAATTGGGGGCGCATCACTATTGAAGCGCACTTGGGAGCAGGCTGTTAAGGGGCTAAAAG |
| CRE2_IMP_6_0.95 (SEQ ID NO: 47) | GAAAAGTTAGTCACTTGGTTTGTGGAACGTGGCTATAAAATAAAAGGCAGTATTTCCTCTCATTTTCATAGCGACAGCACGGGCGGAATAGAGTGGCTTA |
| CRE2_IMP_7_0.95 (SEQ ID NO: 48) | TATGCATCTGAATTAACAAATGAACTTCTTAAAAAAGACGGTAAGGTACAAGCTAAAAATTCATTTAGCGGAGTTAGCTATTGGCTAGTTAAGAAAAAGA |
| CRE2_VIM_1_0.95 (SEQ ID NO: 49) | CTCTAGTGGAGATGTGGTGCGCTTCGGTCCCGTAGAGGTTTTCTATCCTGGTGCTGCGCATTCGGGCGACAATCTTGTGGTATACGTGCCGGCCGTGCGC |
| CRE2_VIM_2_3_0.95 (SEQ ID NO: 50) | TGATGGTGATGAGTTGCTTTTGATTGATACAGCGTGGGGTGCGAAAAACACAGCGGCACTTCTCGCGGAGATTGAGAAGCAAATTGGACTTCCCGTAACG |
| OXA10_0.95 (SEQ ID NO: 51) | CATAAAGAATGAGCATCAGGTTTTCAAATGGGACGGAAAGCCAAGAGCCATGAAGCAATGGGAAAGAGACTTGACCTTAAGAGGGGCAATACAAGTTTCA |

The analysis herein also identified eighteen relevant target sequences to be targeted by KpMero4 probe targets (e.g., probeset), which are shown in Table 2.

TABLE 2

KpMero4 Target Sequences
KpMero4 Probes Targets:

| Target: | target sequence in gene |
|---|---|
| KpMero4_C_KPN_00050_0.97 (SEQ ID NO: 52) | AGATCGTGCTTACCGCATGCTGATGAACCGCAAATTCTCTGAAGAAGCGGCAACCTGGATGCAGGAACAGCGCGCCAGTGCGTATGTTAAAATTCTGAGC |
| KpMero4_C_KPN_00098_0.97 (SEQ ID NO: 53) | GGAACGTTGTGGTCTGAAAGTTGACCAACTTATTTTCGCCGGGTTAGCGGCCAGTTATTCGGTATTAACAGAAGACGAACGTGAGCTGGGCGTCTGCGTT |
| KpMero4_C_KPN_00100_0.97 (SEQ ID NO: 54) | TCGATTGTGCCATCGTTGTTGACGATTATCGCGTACTGAACGAAGACGGTCTGCGCTTTGAAGACGAATTTGTTCGCCACAAAATGCTGGATGCGATCGG |
| KpMero4_C_KPN_01276_0.92 (SEQ ID NO: 55) | ATGCTGGAGTTGTTGTTTCTGCTTTTACCCGTTGCCGCCGCTTACGGCTGGTACATGGGGCGCAGAAGTGCACAACAGTCCAAACAGGACGATGCGAGCC |
| KpMero4_C_KPN_02846_0.95 (SEQ ID NO: 56) | GCGCAGGATCTGGTGATGAACTTTTCCGCCGACTGCTGGCTGGAAGTGAGCGATGCCACCGGTAAAAAACTGTTCAGCGGCCTGCAGCGTAAAGGCGGTA |
| KpMero4_C_KPN_03317_0.92 (SEQ ID NO: 57) | ATGGCCGGGGAACACGTCATTTTGCTGGATGAGCAGGATCAGCCTGCCGGTATGCTGGAGAAGTATGCCGCCCATACGTTTGATACCCCTTTACATCTCG |
| KpMero4_C_KPN_03634_0.92 (SEQ ID NO: 58) | AGCAATGACGGCGAAACGCCGGAAGGCATTGGCTTTGCGATCCCGTTCCAGTTAGCGACCAAAATTATGGATAAACTGATCCGCGATGGCCGGGTGATCC |
| KpMero4_C_KPN_04666_0.97 (SEQ ID NO: 59) | CAGGCCAGCGATGGTAACGCGGTGATGTTTATCGAAAGCGTCAACGGCAACCGCTTCCATGACGTCTTCCTTGCCCAGCTGCGTCCGAAAGGCAATGCGC |
| KpMero4_R01up_KPN_01226_0.97 (SEQ ID NO: 60) | GCGCGATGCACGATCTGATCGCCAGCGACACCTTCGATAAGGCGAAGGCGGAAGCGCAGATCGATAAGATGGAAGCGCAGCATAAAGCGATGGCGCTGTC |
| KpMero4_R02up_KPN_01107_0.97 (SEQ ID NO: 61) | GCTGTCGCTGGTCTCAACGTGTTGGATCGCGGCCCGCAGTATGCGCAAGTGGTCTCCAGTACACCGATTAAAGAAACCGTGAAAACGCCGCGTCAGGAAT |
| KpMero4_R03up_KPN_02345_0.95 (SEQ ID NO: 62) | ATGCGAATCGCGCTTTTCCTGCTGACGAACCTGGCAGTGATGGTCGTGTTCGGGCTGGTGTTAAGCCTCACGGGGATCCAATCCAGCAGCATGACCGGTC |
| KpMero4_R04up_KPN_02742_0.97 (SEQ ID NO: 63) | CAAATAGGCGATCGTGACAATTACGGTAACTACTGGGACGGTGGCAGCTGGCGCGACCGTGATTACTGGCGTCGTCACTATGAATGGCGTGATAACCGTT |
| KpMeRo4_R05dn_KPN_02241_0.92 (SEQ ID NO: 64) | GGGTAGGTTACTCCATTCTGAACCAGCTTCCGCAGCTTAACCTGCCACAATTCTTTGCGCATGGCGCAATCCTAAGCATCTTCGTTGGCGCAGTGCTCTG |
| KpMero4_R06up_KPN_03358_0.92 (SEQ ID NO: 65) | GGGCGAAAAACTGGTGAACTCGCAGTTCTCCCAGCGTCAGGAATCGGAAGCGGATGACTACTCTTACGACCTGCTGCGTAAGCGCGGTATCAATCCGTCG |
| KpMero4_R07up_KPN_03934_0.92 (SEQ ID NO: 66) | TGCCTTATATTACCAAGCAGAATCAGGCGATTACTGCGGATCGTAACTGGCTTATTTCCAAGCAGTACGATGCTCGCTGGTCGCCGACTGAGAAGGCGCG |
| KpMeRo4_R08dn_KPN_00868_0.92 (SEQ ID NO: 67) | TGCAACTGCGAAAGGCCAAAGGCTACATGTCAGTCAGCGAAAATGACCATCTGCGTGATAACTTGTTTGAGCTTTGCCGTGAAATGCGTGCGCAGGCGCC |
| KpMero4_R09up_KPN_02342_0.97 (SEQ ID NO: 68) | TATGGGGTGTTATTCCACAGTGAGGAAAACGTCGGCGGTCTGGGTCTTAAGTGCCAATACCTCACCGCCCGCGGAGTCAGCACCGCACTTTATGTTCATT |
| KpMero4_R010up_KPN_00833_0.97 (SEQ ID NO: 69) | AACCACTTTAGATGGTCTGGAAGCAAAACTGGCTGCTAAAGCCGAAGCCGCTGGCGCGACCGGCTACAGCATTACTTCCGCTAACACCAACAACAAACTG |

To facilitate identification of Cre2 probe targets, bipartite probes comprising a probe A and a probe B were constructed as shown in Table 3 and Table 4, respectively.

TABLE 3

Cre2 Probe A Sequences
CRE2 probes:

| Target: | probe A sequence |
|---|---|
| ST258_wzi_1 (SEQ ID NO: 70) | AACACCTTTCAGAGTATCGGCATGAGGGAACGCTTTATTTATTGACTGGTCCTCAAGACCTAAGCGACAGCGTGACCTTGTTTCA |

TABLE 3-continued

Cre2 Probe A Sequences
CRE2 probes:

| Target: | probe A sequence |
|---|---|
| ST258_wzy_1 (SEQ ID NO: 71) | AAAACTGCTAAGCCTGCAATTGGTATTAGCAATATATAGATTAGTTTTTTCATCCT CTTCTTTTCTTGGTGTTGAGAAGATGCTC |
| ST58_wzi_2 (SEQ ID NO: 72) | CGCTGATTGATACGAGCCAGAACTACCTGCTCAGAGGAATAGGAAGGTTTCACAAT TCTGCGGGTTAGCAGGAAGGTTAGGGAAC |
| ST258_wzy_2 (SEQ ID NO: 73) | CCGTATTCAGGTCAAAGTAAAGTTGCGCTTTATAGCTGATAAATGTTGGCCTGTTG AGATTATTGAGCTTCATCATGACCAGAAG |
| CRE2_KPC_0.95 (SEQ ID NO: 74) | ACAGCTCCGCCACCGTCATGCCTGTTGTCAGATATCAAAGACGCCTATCTTCCAGT TTGATCGGGAAACT |
| CRE2_NDM_0.95 (SEQ ID NO: 75) | AGCTGGCGGAAAACCAGATCGCCAAACCGTTGGTCGCCAGTTTCCATTTGCGAACC TAACTCCTCGCTACATTCCTATTGTTTTC |
| CRE2_OXA48_0.95 (SEQ ID NO: 76) | GTCTACATTGCCCGAAATGTCCTCATTACCATAATCGAAAGCATGTAGCACCAATT TGGTTTTACTCCCCTCGATTATGCGGAGT |
| CRE2_CTXM15_0.95 (SEQ ID NO: 77) | GATTTTTTGATCTCAACTCGCTGATTTAACAGATTCGGTTCGCTTTCACTCTTTCG GGTTATATCTATCATTTACTTGACACCCT |
| CRE2_IMP_1_0.95 (SEQ ID NO: 78) | CCCCAACCGTTAACTTCTTCGAACGATGTATGAACATAAACACCTTCTTCCAACAG CCACTTTTTTTCCAAATTTTGCAAGAGCC |
| CRE2_IMP_3_8_0.95 (SEQ ID NO: 79) | AACCAAACCACTACGTTATCTTGAGTGTGCCCCGGGCCGGGATAAAAAACCACCGT GTGGACGGCAACTCAGAGATAACGCATAT |
| CRE2_IMP_2_4_0.95 (SEQ ID NO: 80) | GTGCCTTTGATTTTATAGCCGCGCTCCACAAACCAATTGACTAACTTTTCCCTGGA GTTTATGTATTGCCAACGAGTTTGTCTTT |
| CRE2_IMP_5_0.95 (SEQ ID NO: 81) | CCCCCAATTTCACTATGACTCGAAACAACCAGTTTTGCATTACCATACTTCAGATA AGGTTGTTATTGTGGAGGATGTTACTACA |
| CRE2_IMP_6_0.95 (SEQ ID NO: 82) | CTGCCTTTTATTTTATAGCCACGTTCCACAAACCAAGTGACTAACTTTTCCTTCCT TCCTGTGTTCCAGCTACAAACTTAGAAAC |
| CRE2_IMP_7_0.95 (SEQ ID NO: 83) | TGTACCTTACCGTCTTTTTTAAGAAGTTCATTTGTTAATTCAGATGCATACATAAA ATTGGTTTTGCCTTTCAGCAATTCAACTT |
| CRE2_VIM_1_0.95 (SEQ ID NO: 84) | GAAAACCTCTACGGGACCGAAGCGCACCACATCTCCACTAGAGCTGGTCAAGACTT GCATGAGGACCCGCAAATTCCT |
| CRE2_VIM_2_3_0.95 (SEQ ID NO: 85) | CGCACCCCACGCTGTATCAATCAAAAGCAACTCATCACCATCACTTTCGTTGGGAC GCTTGAAGCGCAAGTAGAAAAC |
| OXA10_0.95 (SEQ ID NO: 86) | TGGCTCTTGGCTTTCCGTCCCATTTGAAAACCTGATGCTCATTCTTTATGCCAGCA GACCTGCAATATCAAAGTTATAAGCGCGT |

TABLE 4

Cre2 Probe B Sequences
CRE2 probes:

| Target: | probe B sequence |
|---|---|
| ST258_wzi_1 (SEQ ID NO: 87) | CGAAAGCCATGACCTCCGATCACTCGAAGTGTTAATTCGAACCGACTGATAAAC ATTCCCACTCCATCCCAGCTG |
| ST258_wzy_1 (SEQ ID NO: 88) | CGAAAGCCATGACCTCCGATCACTCGTTCATATGATGTATAACCATCATGCGAC AGCCTCTCCTGAAAAATTGCA |
| ST58_wzi_2 (SEQ ID NO: 89) | CGAAAGCCATGACCTCCGATCACTCCGGTCGAGGTATAGCCGGTGACCCGGAAA TCGGCTTTTAACGCTGACAGT |
| ST258_wzy_2 (SEQ ID NO: 90) | CGAAAGCCATGACCTCCGATCACTCAAGACTTCCAAATCCCATTGCAACTGCTG TAACTCTTTTAAGGTCTCCTT |
| CRE2_KPC_0.95 (SEQ ID NO: 91) | CGAAAGCCATGACCTCCGATCACTCCAGCAACAAATTGGCGGCGGCGTTATCAC TGTATTGCACGGCGGCCGCGG |
| CRE2_NDM_0.95 (SEQ ID NO: 92) | CGAAAGCCATGACCTCCGATCACTCCGAAACCCGGCATGTCGAGATAGGAAGTG TGCTGCCAGACATTCGGTGCG |

TABLE 4-continued

| Cre2 Probe B Sequences CRE2 probes: | |
|---|---|
| Target: | probe B sequence |
| CRE2_OXA48_0.95 (SEQ ID NO: 93) | CGAAAGCCATGACCTCCGATCACTCCTGATTTGCTCCGTGGCCGAAATTCGAAT ACCACCGTCGAGCCAGAAACT |
| CRE2_CTXM15_0.95 (SEQ ID NO: 94) | CGAAAGCCATGACCTCCGATCACTCTCGTCCCATTGACGTGCTTTTCCGCAATC GGATTATAGTTAACAAGGTCA |
| CRE2_IMP_1_0.95 (SEQ ID NO: 95) | CGAAAGCCATGACCTCCGATCACTCGATAGGCGTCAGTGTTTACAAGAACCACC AAACCGTGTTTAGAAACAACA |
| CRE2_IMP_3_8_0.95 (SEQ ID NO: 96) | CGAAAGCCATGACCTCCGATCACTCGACCGTCCGGTTTAACAAAACAACCACCG AATAAAATTTTCTTTTCAGGT |
| CRE2_IMP_2_4_0.95 (SEQ ID NO: 97) | CGAAAGCCATGACCTCCGATCACTCTAAGCCACTCTATTCCCCCTGTGCTGTCG CTATGGAAATGTGAGGAAATA |
| CRE2_IMP_5_0.95 (SEQ ID NO: 98) | CGAAAGCCATGACCTCCGATCACTCCCCTTAACAGCCTGCTCCCAAGTGCGCTT CAATAGTGATGCG |
| CRE2_IMP_6_0.95 (SEQ ID NO: 99) | CGAAAGCCATGACCTCCGATCACTCTAAGCCACTCTATTCCGCCCGTGCTGTCG CTATGAAAATGAGAGGAAATA |
| CRE2_IMP_7_0.95 (SEQ ID NO: 100) | CGAAAGCCATGACCTCCGATCACTCTCTTTTTCTTAACTAGCCAATAGCTAACT CCGCTAAATGAATTTTTAGCT |
| CRE2_VIM_1_0.95 (SEQ ID NO: 101) | CGAAAGCCATGACCTCCGATCACTCCGTATACCACAAGATTGTCGCCCGAATGC GCAGCACCAGGATA |
| CRE2_VIM_2_3_0.95 (SEQ ID NO: 102) | CGAAAGCCATGACCTCCGATCACTCCAATTTGCTTCTCAATCTCCGCGAGAAGT GCCGCTGTGTTTTT |
| OXA10_0.95 (SEQ ID NO: 103) | CGAAAGCCATGACCTCCGATCACTCTGAAACTTGTATTGCCCCTCTTAAGGTCA AGTCTCTTTCCCATTGCTTCA |

Similarly, to facilitate identification of KpMero4 probe targets, bipartite probes comprising a probe A and a probe B were constructed as shown in Table 5 and Table 6, respectively.

TABLE 5

| KpMero4 Probe A Sequences KpMero4 probes: | |
|---|---|
| Target: | probe A sequence |
| KpMero4_C_KPN_00050_0.97 (SEQ ID NO: 104) | CCGCTTCTTCAGAGAATTTGCGGTTCATCAGCATGCGGTAAGCACGATCCT GCCAATGCACTCGATCTTGTCATTTTTTTGCG |
| KpMero4_C_KPN_00098_0.97 (SEQ ID NO: 105) | CCGCTAACCCGGCGAAAATAAGTTGGTCAACTTTCAGACCACAACGTTCCC AAACTGGAGAGAGAAGTGAAGACGATTTAACCCA |
| KpMero4_C_KPN_00100_0.97 (SEQ ID NO: 106) | ACCGTCTTCGTTCAGTACGCGATAATCGTCAACAACGATGGCACAATCGAC GATTGCTGCATTCCGCTCAACGCTTGAGGAAGTA |
| KpMero4_C_KPN_01276_0.92 (SEQ ID NO: 107) | CAGCCGTAAGCGGCGGCAACGGGTAAAAGCAGAAACAACAACTCCAGCATC TGAGGCTGTTAAAGCTGTAGCAACTCTTCCACGA |
| KpMero4_C_KPN_02846_0.95 (SEQ ID NO: 108) | CTCACTTCCAGCCAGCAGTCGGCGGAAAAGTTCATCACCAGACTAGGACGC AAATCACTTGAAGAAGTGAAAGCGAG |
| KpMero4_C_KPN_03317_0.92 (SEQ ID NO: 109) | CCGGCAGGCTGATCCTGCTCATCCAGCAAAATGACGTGTTCCCCACGCGAT GACGTTCGTCAAGAGTCGCATAATCT |
| KpMero4_C_KPN_03634_0.92 (SEQ ID NO: 110) | TGGAACGGGATCGCAAAGCCAATGCCTTCCGGCGTTTCGCCGCATTTGGAA TGATGTGTACTGGGAATAAGACGACG |
| KpMero4_C_KPN_04666_0.97 (SEQ ID NO: 111) | TTGCCGTTGACGCTTTCGATAAACATCACCGCGTTACCATCGCTGGCCTGC ACAAGAATCCCTGCTAGCTGAAGGAGGGTCAAAC |
| KpMero4_R01up_KPN_01226_0.97 (SEQ ID NO: 112) | CGCCTTCGCCTTATCGAAGGTGTCGCTGGCGATCAGATCGTGCTTGACGTA GATTGCTATCAGGTTACGATGACTGC |

TABLE 5-continued

| KpMero4 Probe A Sequences<br>KpMero4 probes: | |
|---|---|
| Target: | probe A sequence |
| KpMero4_R02up_KPN_01107_0.97 (SEQ ID NO: 113) | ACTTGCGCATACTGCGGGCCGCGATCCAACACGTTGAGACCACTTACAGAT CGTGTGCTCATGACTTCCACAGACGT |
| KpMero4_R03up_KPN_02345_0.95 (SEQ ID NO: 114) | AACACGACCATCACTGCCAGGTTCGTCAGCAGGAAAAGCGCGATTCGCATC TTGGAGGAGTTGATAGTGGTAAAACAACATTAGC |
| KpMero4_R04up_KPN_02742_0.97 (SEQ ID NO: 115) | CAGCTGCCACCGTCCCAGTAGTTACCGTAATTGTCACGATCGCCTACGTAT ATATCCAAGTGGTTATGTCCGACGGC |
| KpMero4_R05dn_KPN_02241_0.92 (SEQ ID NO: 116) | TTGTGGCAGGTTAAGCTGCGGAAGCTGGTTCAGAATGGAGTAACCTACCAG CAAGAAGGAGTATGGAACTTATAGCAAGAGAG |
| KpMero4_R06up_KPN_03358_0.92 (SEQ ID NO: 117) | CTTCCGATTCCTGACGCTGGGAGAACTGCGAGTTCACCAGTTCACCCCTCC AAACGCATTCTTATTGGCAAATGGAA |
| KpMero4_R07up_KPN_03934_0.92 (SEQ ID NO: 118) | CCAGTTACGATCCGCAGTAATCGCCTGATTCTGCTTGGTAATATAAGGCAC CCGAAGCAATACTGTCGTCACTCTGTATGTCCGT |
| KpMero4_R08dn_KPN_00868_0.92 (SEQ ID NO: 119) | ATGGTCATTTTCGCTGACTGACATGTAGCCTTTGGCCTTTCGCCGGGAATC GGCATTTCGCATTCTTAGGATCTAAA |
| KpMero4_R09up_KPN_02342_0.97 (SEQ ID NO: 120) | TTAAGACCCAGACCGCCGACGTTTTCCTCACTGTGGAATAACACCCCATAC CGATCTTCATAACGGACAAACTGAACGGGCCATT |
| KpMero4_R10up_KPN_00833_0.97 (SEQ ID NO: 121) | CGGCTTCGGCTTTAGCAGCCAGTTTTGCTTCCAGACCATCTAAAGCGCTAT GCAGACGAGCTGGCAGAGGAGAGAAATCA |

TABLE 6

| KpMero4 Probe B Sequences<br>KpMero4 probes: | |
|---|---|
| Target: | probe B sequence |
| KpMero4_C_KPN_00050_0.97 (SEQ ID NO: 122) | CGAAAGCCATGACCTCCGATCACTCCAGAATTTTAACATACGCA CTGGCGCGCTGTTCCTGCATCCAGGTTG |
| KpMero4_C_KPN_00098_0.97 (SEQ ID NO: 123) | CGAAAGCCATGACCTCCGATCACTCAACGCAGACGCCCAGCTCA CGTTCGTCTTCTGTTAATACCGAATAACTGG |
| KpMero4_C_KPN_00100_0.97 (SEQ ID NO: 124) | CGAAAGCCATGACCTCCGATCACTCCCGATCGCATCCAGCATTT TGTGGCGAACAAATTCGTCTTCAAAGCGCAG |
| KpMero4_C_KPN_01276_0.92 (SEQ ID NO: 125) | CGAAAGCCATGACCTCCGATCACTCGTTTGGACTGTTGTGCACT TCTGCGCCCCATGTAC |
| KpMero4_C_KPN_02846_0.95 (SEQ ID NO: 126) | CGAAAGCCATGACCTCCGATCACTCTTACGCTGCAGGCCGCTGA ACAGTTTTTTACCGGTGGCATCG |
| KpMero4_C_KPN_03317_0.92 (SEQ ID NO: 127) | CGAAAGCCATGACCTCCGATCACTCCGAGATGTAAAGGGGTATC AAACGTATGGGCGGCATACTTCTCCAGCATA |
| KpMero4_C_KPN_03634_0.92 (SEQ ID NO: 128) | CGAAAGCCATGACCTCCGATCACTCGGATCACCCGGCCATCGCG GATCAGTTTATCCATAATTTTGGTCGCTAAC |
| KpMero4_C_KPN_04666_0.97 (SEQ ID NO: 129) | CGAAAGCCATGACCTCCGATCACTCATTGCCTTTCGGACGCAGC TGGGCAAGGAAGACGTCATGGAAGCGG |
| KpMero4_R01up_KPN_01226_0.97 (SEQ ID NO: 130) | CGAAAGCCATGACCTCCGATCACTCCATCGCTTTATGCTGCGCT TCCATCTTATCGATCTGCGCTTC |
| KpMero4_R02up_KPN_01107_0.97 (SEQ ID NO: 131) | CGAAAGCCATGACCTCCGATCACTCCTGACGCGGCGTTTTCACG GTTTCTTTAATCGGTGTACTGGAGACC |
| KpMero4_R03up_KPN_02345_0.95 (SEQ ID NO: 132) | CGAAAGCCATGACCTCCGATCACTCCTGGATTGGATCCCCGTGA GGCTTAACACCAGCCCG |
| KpMero4_R04up_KPN_02742_0.97 (SEQ ID NO: 133) | CGAAAGCCATGACCTCCGATCACTCAACGGTTATCACGCCATTC ATAGTGACGACGCCAGTAATCACGGTCGCGC |

TABLE 6-continued

| KpMero4 Probe B Sequences<br>KpMero4 probes: | |
|---|---|
| Target: | probe B sequence |
| KpMero4_R05dn_KPN_02241_0.92 (SEQ ID NO: 134) | CGAAAGCCATGACCTCCGATCACTCCAGAGCACTGCGCCAACGA AGATGCTTAGGATTGCGCCATGCGCAAAGAA |
| KpMero4_R06up_KPN_03358_0.92 (SEQ ID NO: 135) | CGAAAGCCATGACCTCCGATCACTCCGACGGATTGATACCGCGC TTACGCAGCAGGTCGTAAGAGTAGTCATCCG |
| KpMero4_R07up_KPN_03934_0.92 (SEQ ID NO: 136) | CGAAAGCCATGACCTCCGATCACTCCCTTCTCAGTCGGCGACCA GCGAGCATCGTACTGCTTGGAAATAAG |
| KpMero4_R08dn_KPN_00868_0.92 (SEQ ID NO: 137) | CGAAAGCCATGACCTCCGATCACTCGGCGCCTGCGCACGCATTT CACGGCAAAGCTCAAACAAGTTATCACGCAG |
| KpMero4_R09up_KPN_02342_0.97 (SEQ ID NO: 138) | CGAAAGCCATGACCTCCGATCACTCAATGAACATAAAGTGCGGT GCTGACTCCGCGGGCGGTGAGGTATTGGCAC |
| KpMero4_R10up_KPN_00833_0.97 (SEQ ID NO: 139) | CGAAAGCCATGACCTCCGATCACTCTTGGTGTTAGCGGAAGTAA TGCTGTAGCCGGTCGCGCCAG |

Antibiotic susceptibility testing is typically done by growth-based assays, including broth microdilution (may be automated e.g. on VITEK-2), disk diffusion, or E-test. Other approaches to rapid phenotypic AST include automated microscopy (Accelerate Diagnostics), ultrafine mass measurements (LifeScale). Genotypic approaches include resistance gene detection by PCR or other nucleic acid amplification methods, including Cepheid, BioFire, etc. but are limited to cases for which the genetic basis for resistance is well characterized.

Example 3: AST in ESKAPE Pathogens

The techniques herein are currently being used to conduct AST for: *Escherichia coli, Klebsiella pneumoniae*, and *Acinetobacter baumanii* for three different drug classes (meropenem; ciprofloxacin; gentamicin) along with carbapenemase detection. Additionally, the techniques herein are you being used to conduct AST on all of the ESKAPE pathogens including: *Enterococcus faecalis, Enterococcus faecium, Staphylococcus aureus, K. pneumoniae, A. baumanii, Pseudomonas aeruginosa, E. coli*, and *Enterobacter cloacae* with respect to all major clinically relevant drug classes (e.g., carbapenems, penicillins, cephalosporins, aminoglycosides, fluoroquinolones, rifamycins, and the like). The techniques herein are also being extended to conduct AST on *Mycobacterium tuberculosis* for all first-line and second-line drugs as well as the newer agents, bedaquiline and delamanid.

Figure 2A:
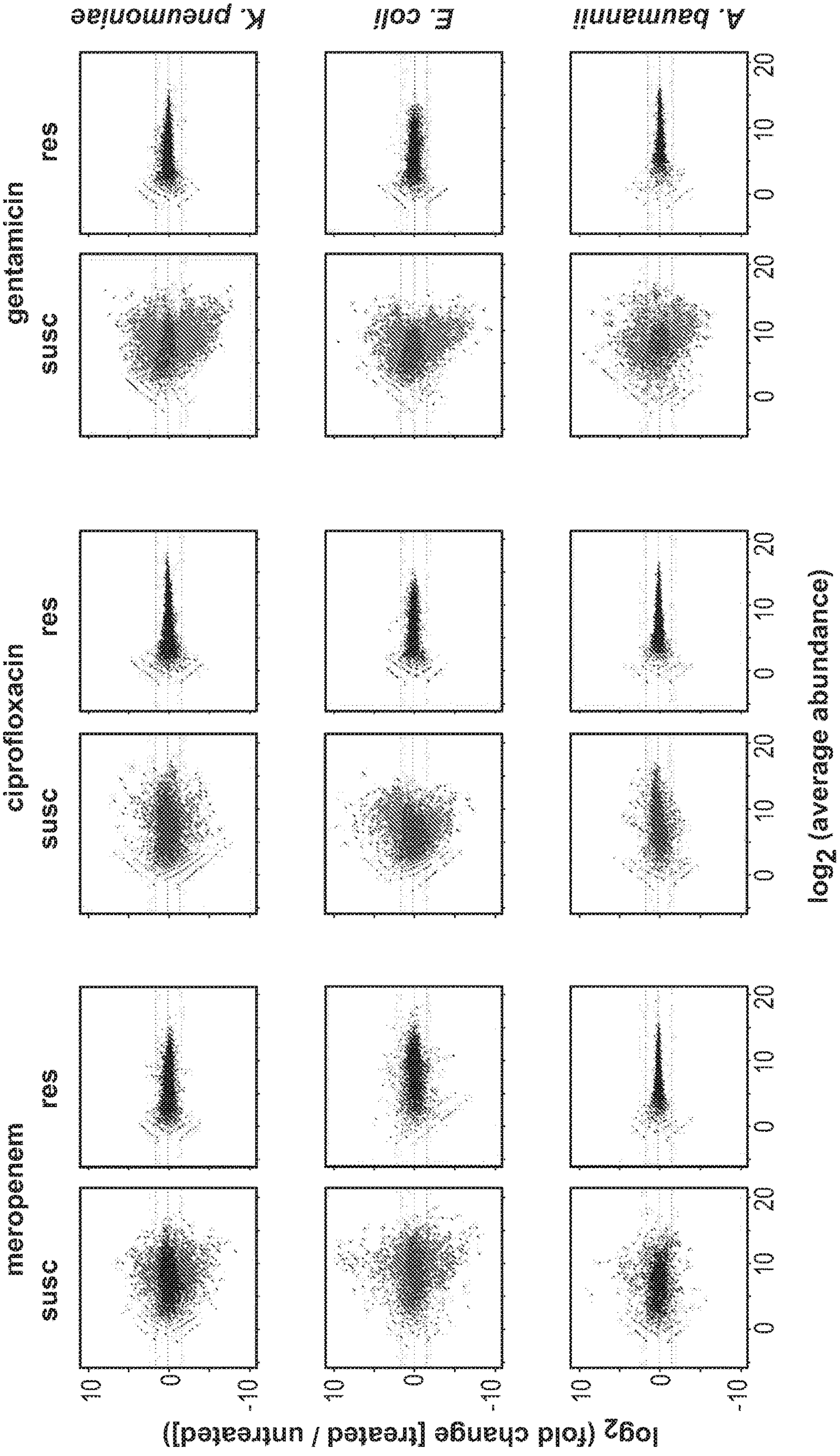
FIGS. 2A-2D depict MA plots showing RNA-Seq data.
Figure 2B:
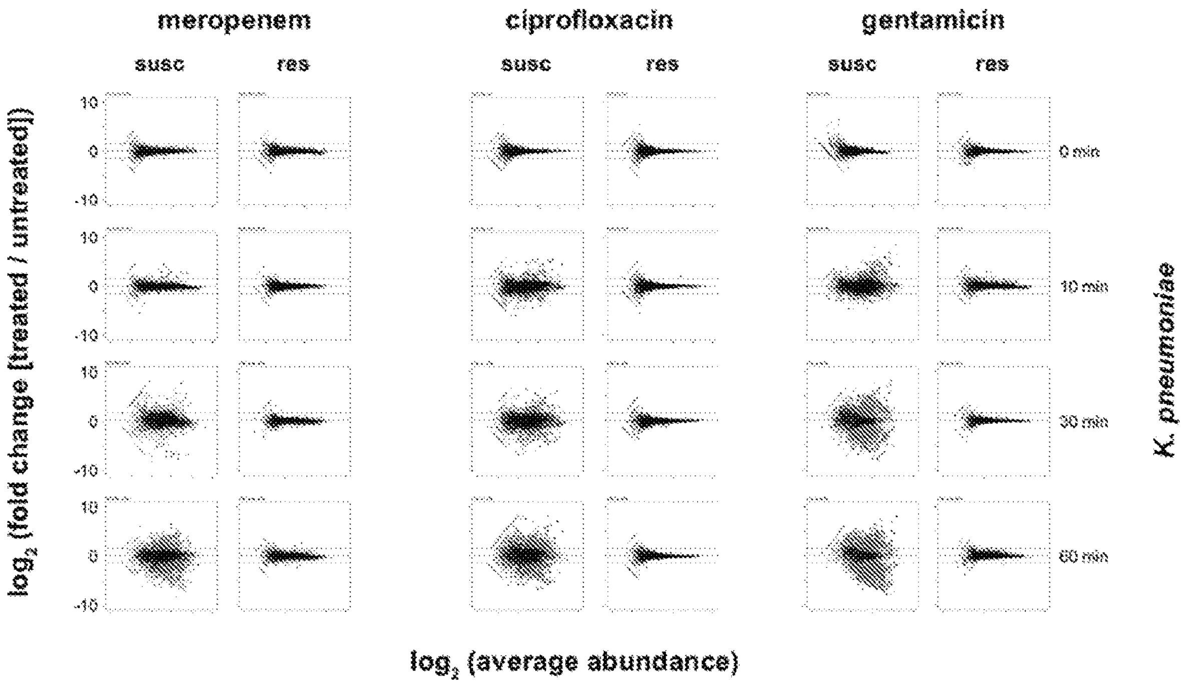
Figure 2C:
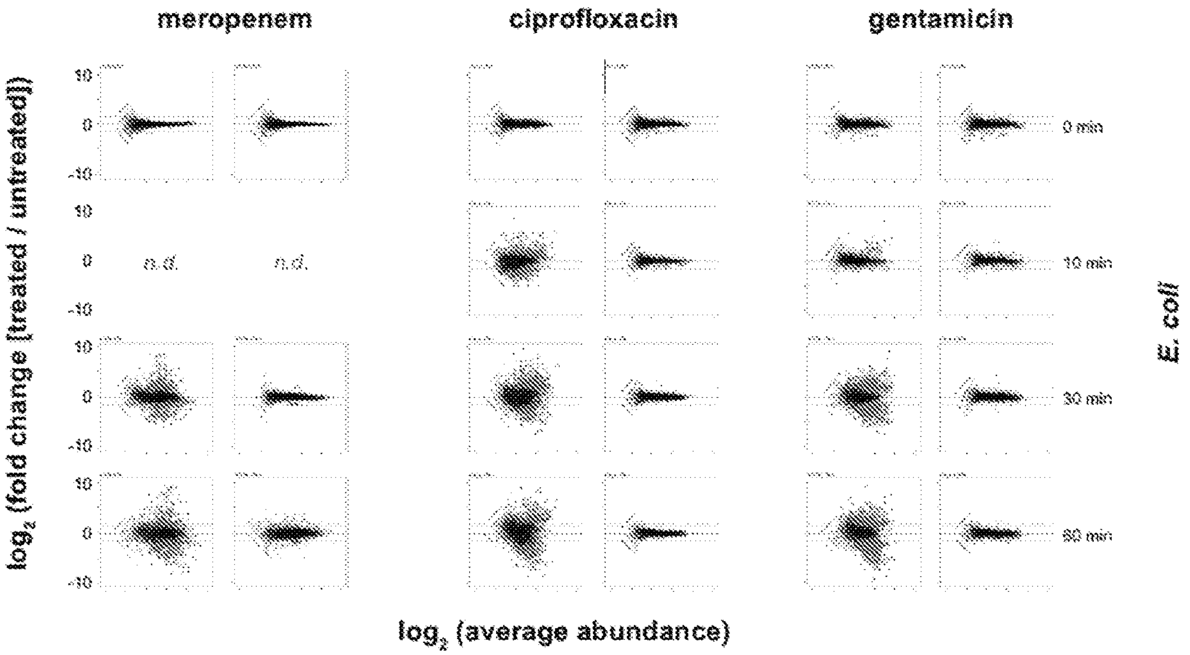
Figure 2D:
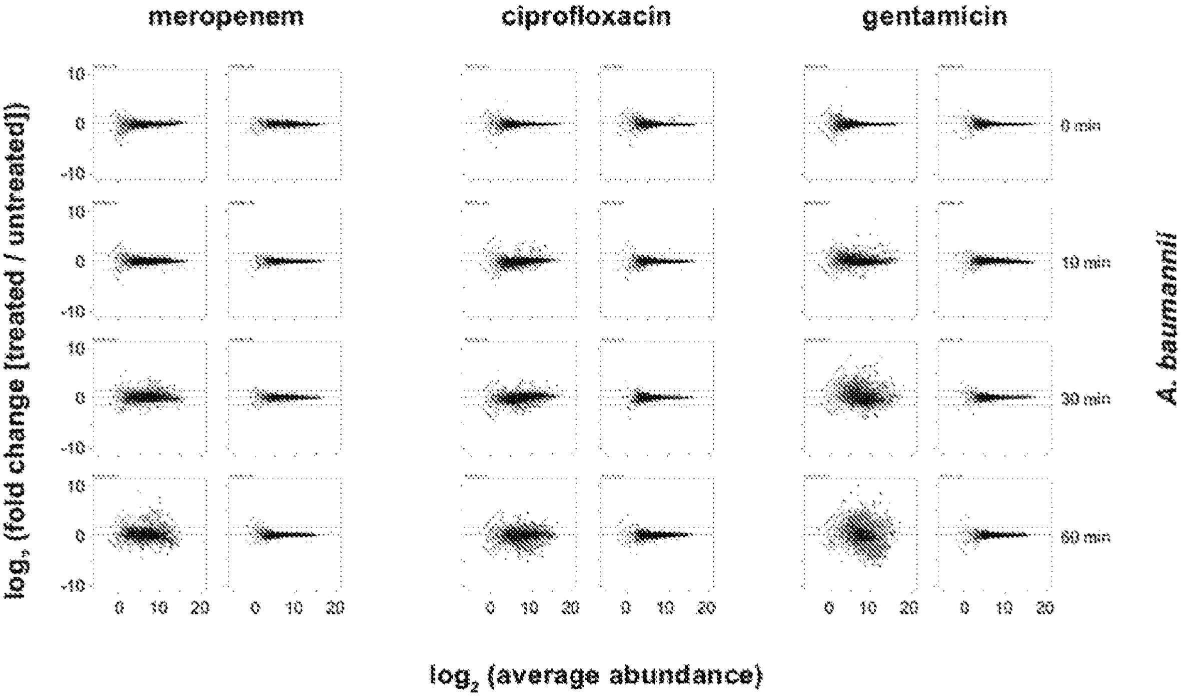

For example, FIGS. 2A-2D, which are described in further detail below, are MA plots showing RNA-Seq data upon antibiotic exposure. FIG. 2A shows MA plots of susceptible (left panels) or resistant (right panels) *Klebsiella pneumoniae, Escherichia coli* or *Acinetobacter baumanii* treated with meropenem for 60 min (left column), ciprofloxacin for 30 min (middle column), or gentamicin for 30-60 min (right column). Transcripts whose expression is statistically significantly changed upon antibiotic exposure are shown in red.

Figure 4A:
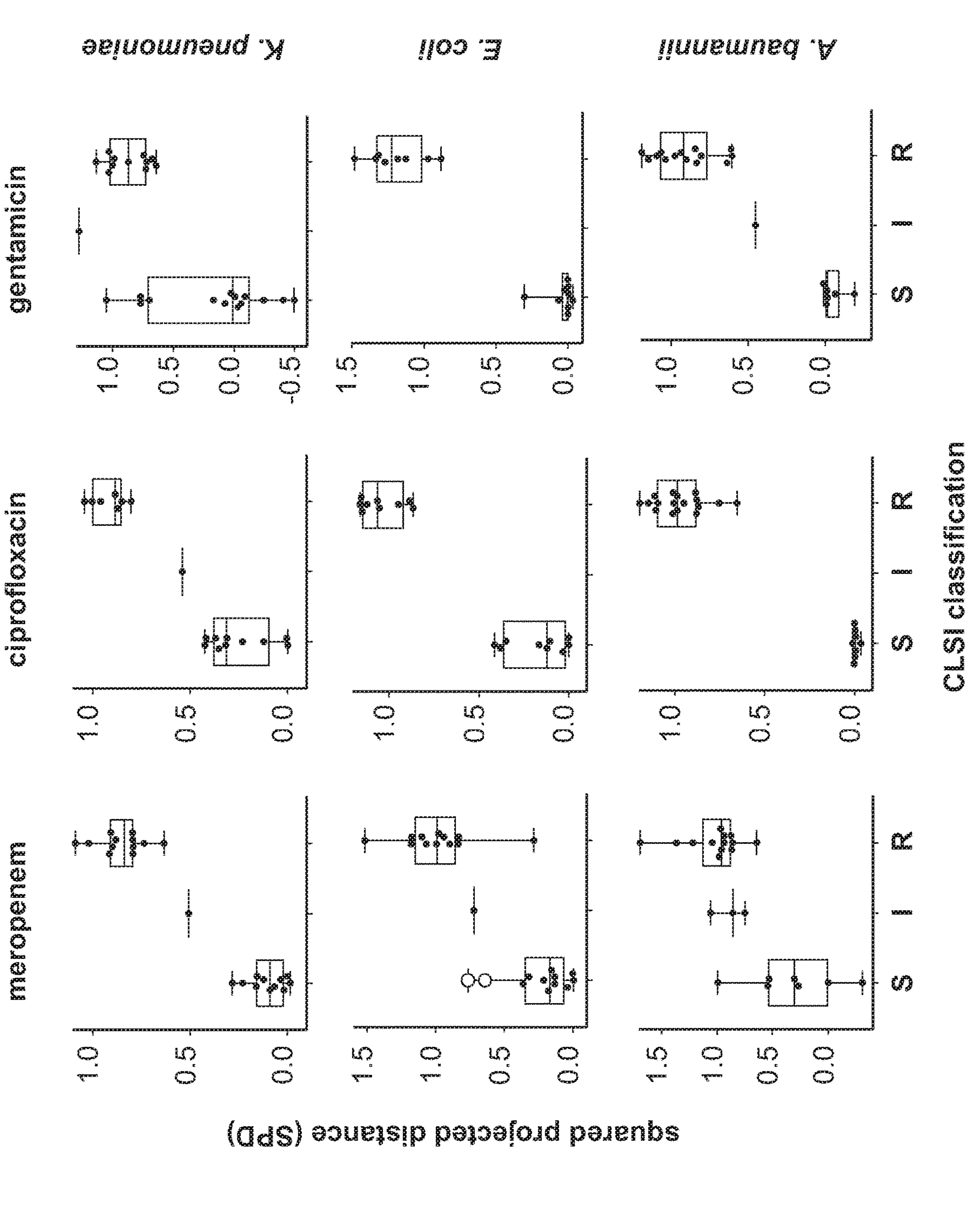
FIGS. 4A and 4B show that a one-dimensional projection of NanoString® data distinguished susceptible from resistant isolates and reflected MIC.
Figure 4B:
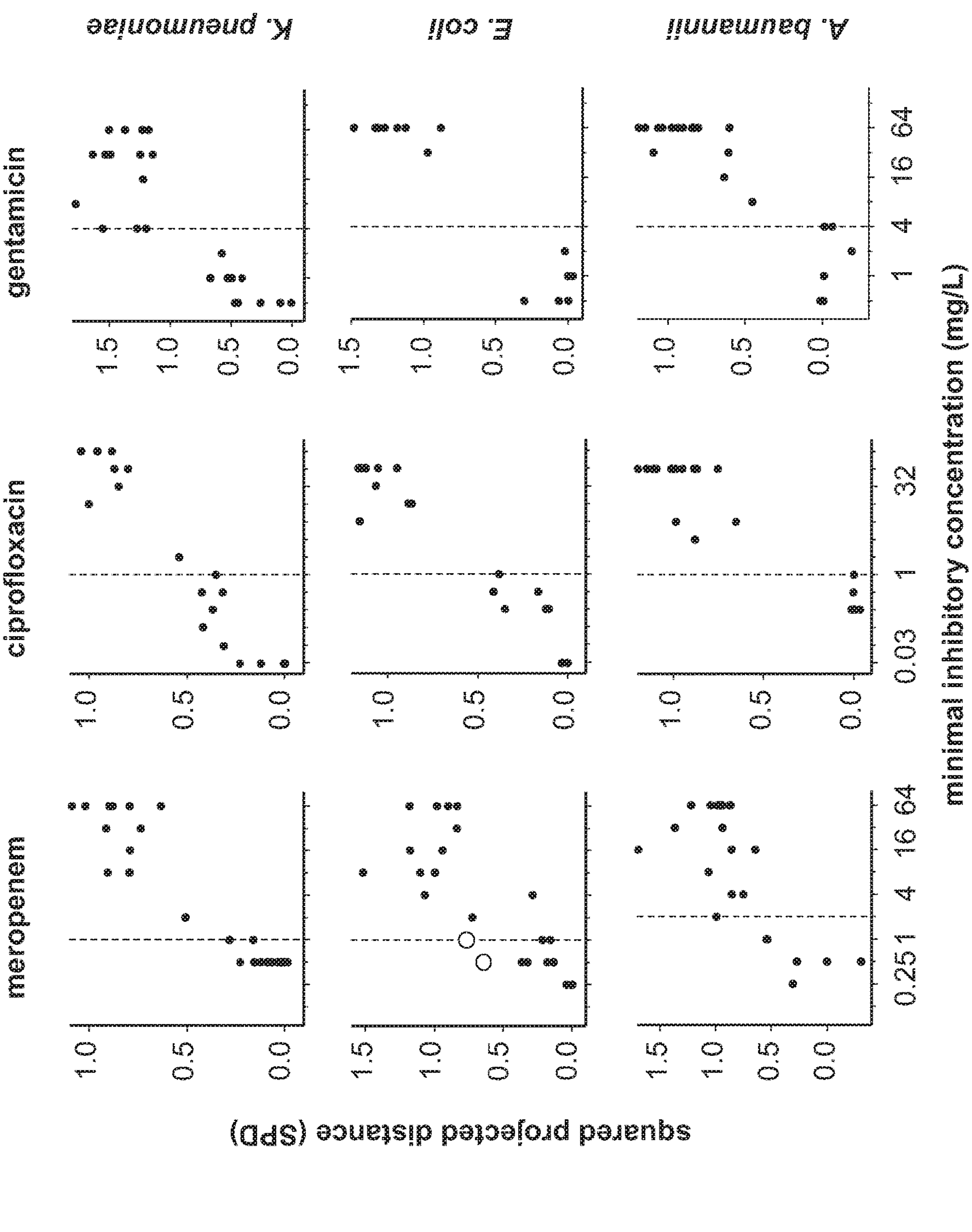

Additionally, FIGS. 4A and 4B, which are described in further detail below, depict graphs showing that the squared projected distance (SPD) from transcriptional signatures reflected antibiotic susceptibility. Clinical isolates of *Klebsiella pneumoniae, Escherichia coli* or *Acinetobacter baumanii* were treated with meropenem for 60 min (left column), ciprofloxacin for 30 min (middle column), or gentamicin for 30-60 min (right column).

Example 4: Determining Optimal Transcriptional Signatures to Discriminate Between Susceptible and Resistant Bacteria To identify the optimal transcripts that most robustly distinguish susceptible and resistant bacteria after brief antibiotic exposure, the transcriptomic responses of two susceptible and two resistant clinical isolates of *K. pneumoniae, E. coli*, and *A. baumannii* (see Table 7 below) treated with either meropenem (a carbapenem that inhibits cell wall biosynthesis), ciprofloxacin (a fluoroquinolone that targets DNA gyrase and topoisomerase), or gentamicin (an aminoglycoside that inhibits protein synthesis) were compared at clinical breakpoint concentrations (CLSI 2018) over time (e.g., 0, 10, 30, 60 minutes) using RNA-Seq. To enable these comparisons, a method optimized and modified from RNAtag-Seq (Shishkin et al. 2015), now termed RNAtag-Seqv2.0, was developed to dramatically decrease the cost and increase the throughput of library construction. For each pathogen, each antibiotic elicited a transcriptional response within 30-60 minutes in susceptible, but not in resistant, organisms (FIGS. 2A-2D).

Figure 3:
FIG. 3 shows that NanoString® data from dozens of antibiotic-responsive genes distinguished susceptible from resistant isolates. Heatmaps of normalized, log-transformed fold-induction of antibiotic-responsive transcripts from 18-24 clinical isolates of *K. pneumoniae* (top), *E. coli* (middle), or *A. baumannii* (bottom) treated at CLSI breakpoint concentrations with meropenem (left), ciprofloxacin (center), or gentamicin (right), with strains arranged in order of MIC for each antibiotic. CLSI classifications are shown below. All antibiotic-responsive transcripts chosen as described from RNA-Seq data are shown here; the subset of these chosen by reliefF as the 10 most discriminating transcripts are shown in FIG. 6 below. *=strains with large inoculum effects in meropenem MIC; +=one-dilution errors; x=strains discordant by more than one dilution.

To identify transcripts that best distinguish susceptible from resistant strains for each pathogen-antibiotic combination, a large number of candidate antibiotic-responsive transcripts from these RNA-Seq datasets was initially selected for evaluation in more clinical isolates using NanoString®. Complicating transcript selection is the fact that antibiotics arrest growth of susceptible strains, resulting in the rapid divergence of culture density and growth phase of treated and untreated cultures, factors that alone affect the transcription of hundreds of genes that can mistakenly be interpreted as the direct result of antibiotic exposure but may not generalize across growth conditions. To enrich for genes specifically perturbed by antibiotic exposure, DESeq2 (Love, Huber, and Anders 2014) was used to identify transcripts whose abundance changed most robustly upon antibiotic exposure (Table 9), followed by Fisher's combined probability test to identify transcripts whose expression changed more upon antibiotic treatment than under any phase of growth during the timecourse. Gene ontology enrichment analysis on the resulting gene lists (Table 8) revealed that meropenem affected lipopolysaccharide biosynthesis in both Enterobacteriaceae species, and induced a heat shock response in both *E. coli* and *Acinetobacter*. Ciprofloxacin induced the SOS response in all three species. Gentamicin induced the unfolded protein response and quinone binding in all three species. The top 60-100 responsive genes (see Methods) were selected as candidates for inclusion in the initial transcriptional signature (FIG. 3; Table 9). For normalization of these responsive genes across samples, DESeq2 was also used to select 10-20 transcripts for each pathogen-antibiotic pair that were most invariant to antibiotic treatment and growth phase ("control transcripts"; see Methods below).

Example 5: A Rapid, Multiplexed Phenotypic Assay to Classify Sensitive and Resistant Bacteria For each of the selected genes for each pathogen-antibiotic pair, probes for multiplexed detection were designed using NanoString®, a simple, quantitative fluorescent hybridization platform that does not require nucleic acid purification (Barczak et al. 2012; Geiss et al. 2008). Because diversity among clinical strains in gene content or sequence may hinder probe hybridization, a homology masking algorithm was devised to identify conserved regions of each target gene (see Methods below), then designed pairs of 50mer probes to the specified conserved regions of the remaining responsive and control transcripts for each pathogen-antibiotic pair (Table 9). Using an assay protocol that was modified from the standard NanoString® nCounter assay to accelerate detection (see Methods below), these probes were used to quantify their cognate transcripts in 18-24 diverse clinical isolates of each species collected from various geographic locations (Table 7), spanning the breadth of the known phylogenetic landscape of each species (Letunic & Bork) (FIGS. 13A-13D). Because of the homology screening step in probe design, each probe recognizes the target transcript from its cognate species, thereby enabling simultaneous species identification through mRNA recognition (see, e.g., Barczak et al.). Normalized expression signatures of all responsive genes are shown as heatmaps (FIG. 3) and summarized as one-dimensional projections (FIGS. 4A-4B). For each pathogen-antibiotic pair tested, the transcriptional profile of susceptible strains was distinct from that of resistant strains (FIG. 4A), with the magnitude of the transcriptional response reflecting the MIC of the exposed isolate (FIG. 4B).

Figure 14A:
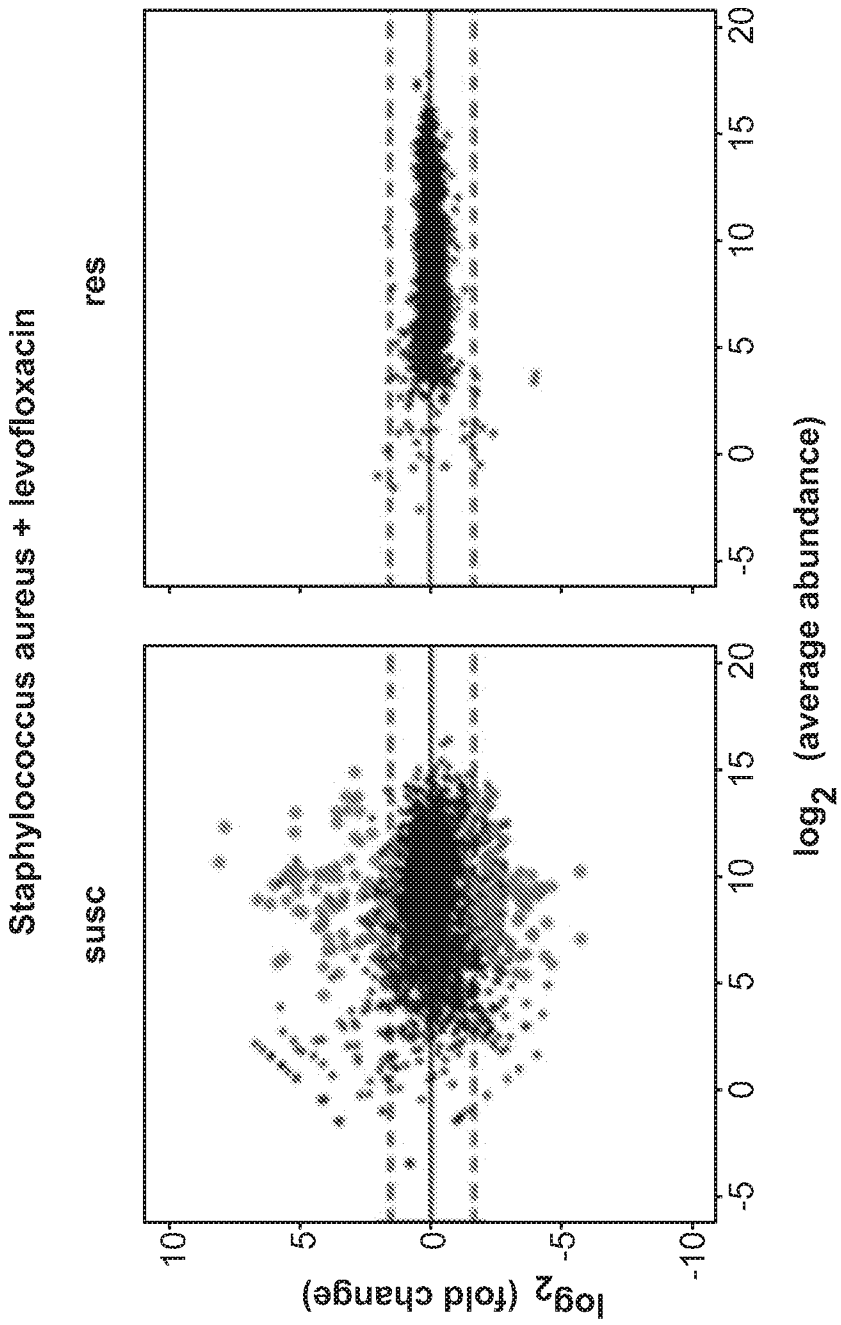
FIGS. 14A-14F show that RNA-Seq and NanoString® data revealed differential gene expression that distinguished susceptible from resistant clinical isolates for *S. aureus*+levofloxacin and *P. aeruginosa*+ciprofloxacin.
Figure 14B:
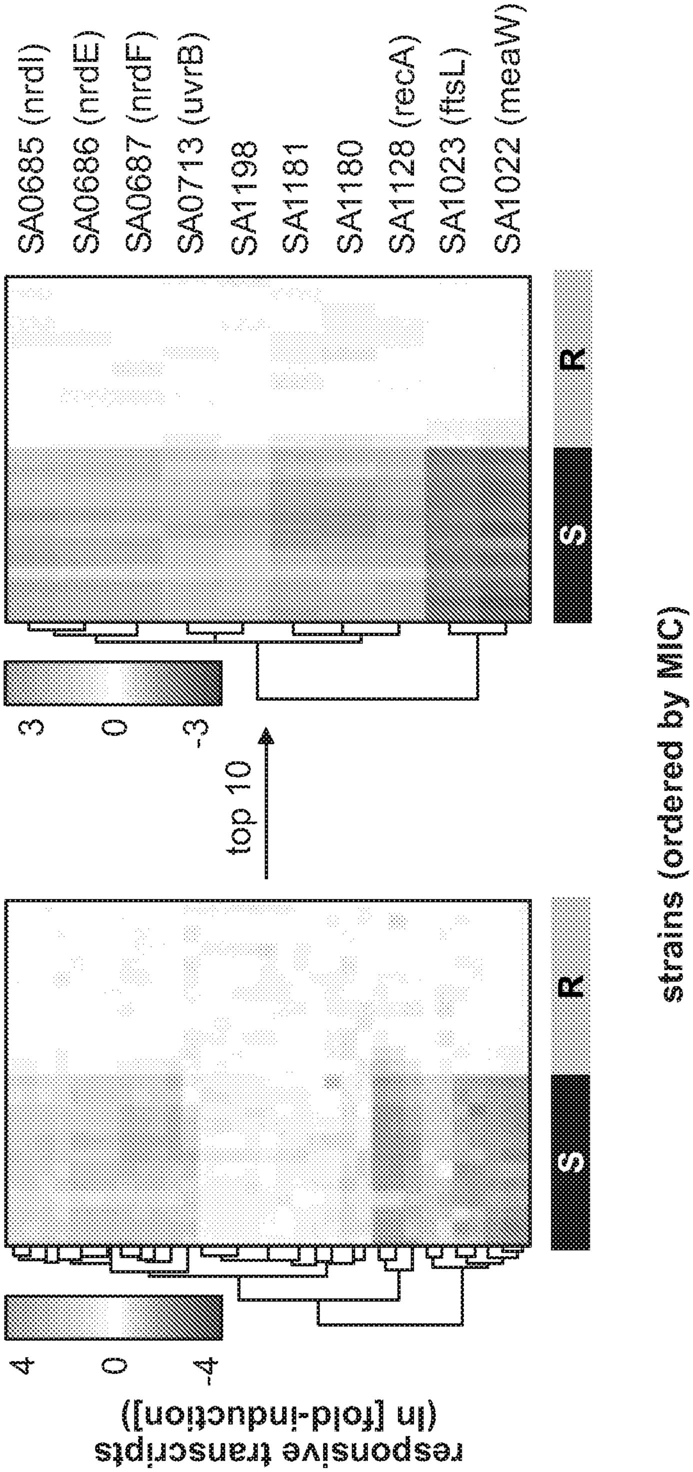
Figure 14C:
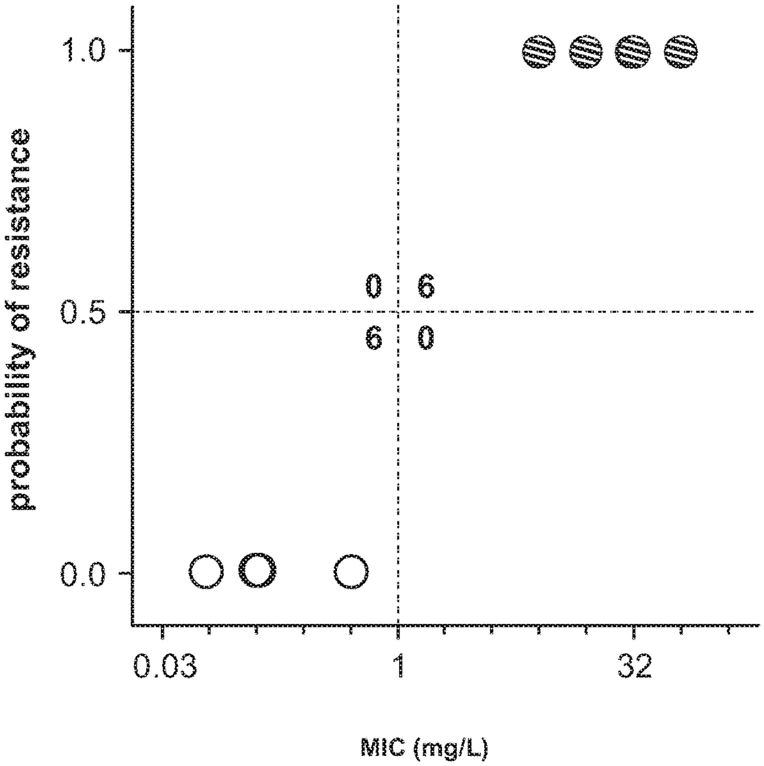
Figure 14D:
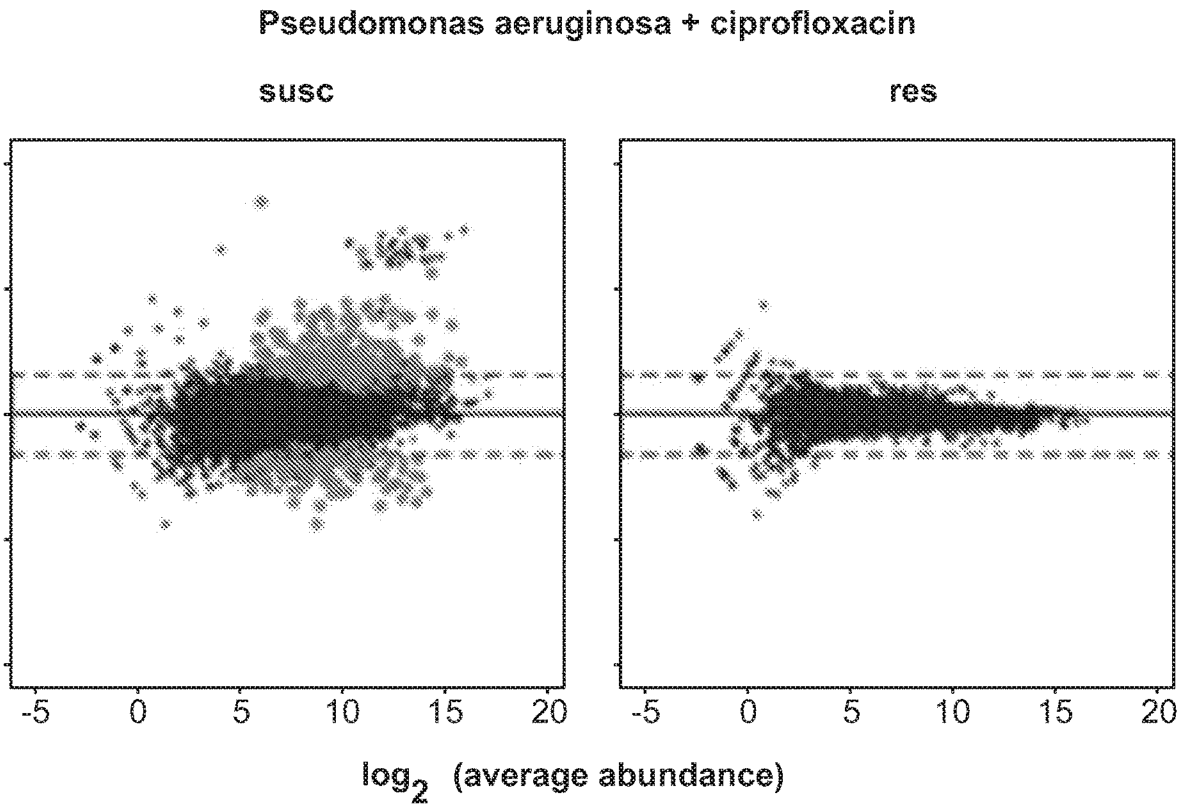
Figure 14E:
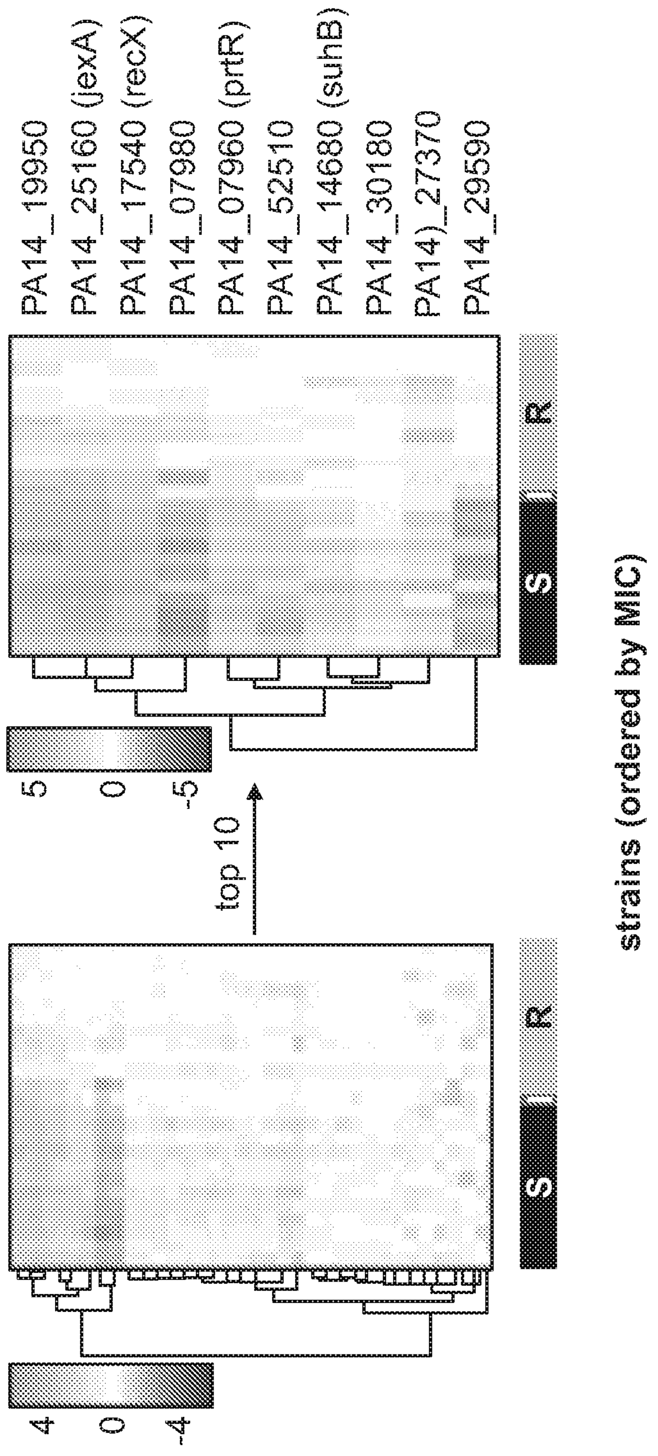
Figure 14F:
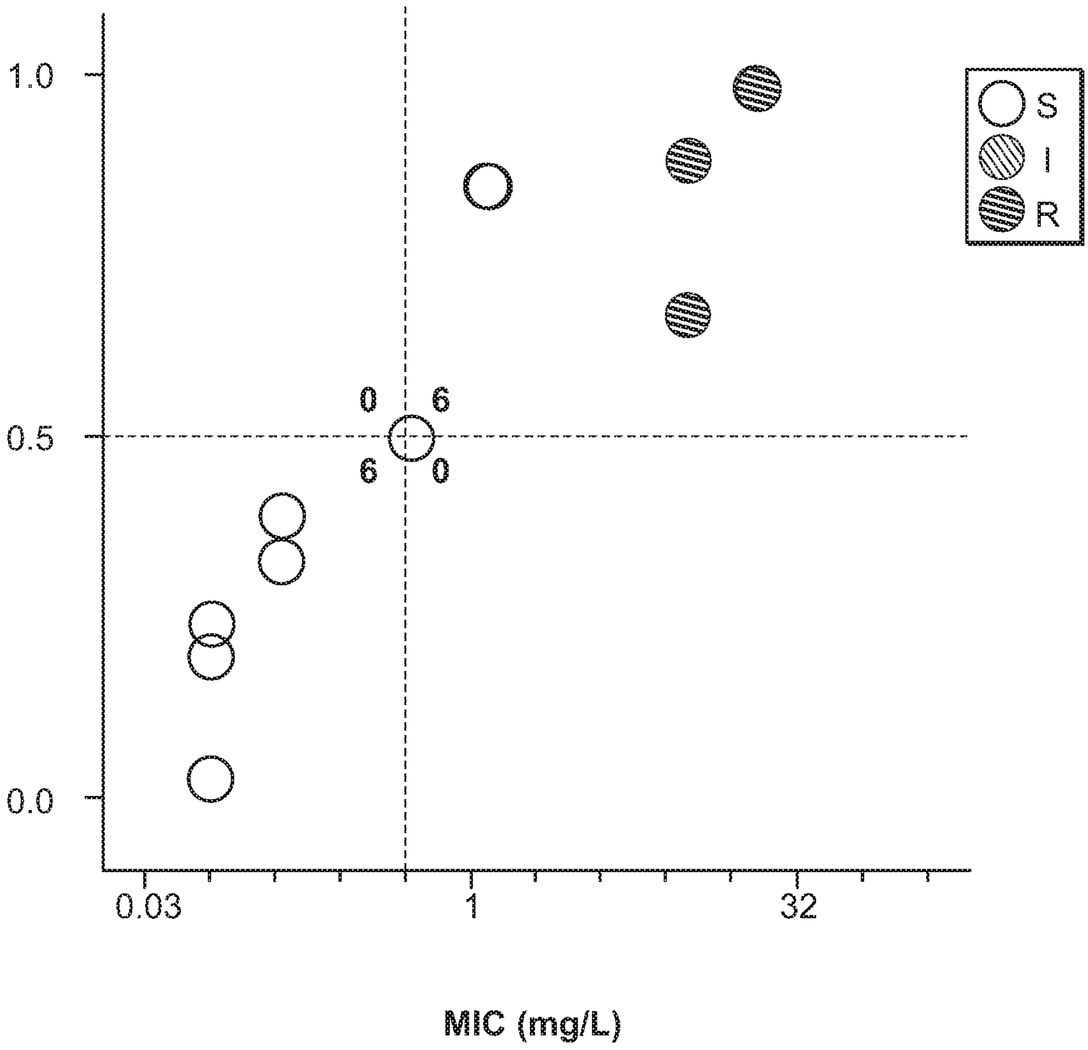

To further test the generalizability of this approach, the above-described steps from RNA-Seq through NanoString® detection of candidate responsive and control genes were repeated for two additional species including a Gram-positive pathogen, *S. aureus*, a common cause of serious infections, and *P. aeruginosa*, another high-priority and frequently multidrug-resistant Gram-negative pathogen, each treated with a fluoroquinolone, levofloxacin (given its greater potency against Gram positives (Hooper et al.)) and ciprofloxacin, respectively (FIGS. 14A-14F). Each showed a robust transcriptional response in susceptible clinical isolates, but no response in resistant isolates, by both RNA-Seq (FIGS. 14A and 14D) and NanoString® (FIGS. 14B and 14E). The overall responses of both pathogens to fluoroquinolones involved up-regulation of the SOS response, as expected (Table 8), including canonical DNA damage-responsive transcripts like lexA, recA, recX, uvrA, and uvrB, which were generally consistent with the genes identified for the other three Gram negative pathogens. However, the specific genes selected from the RNA-Seq data to best distinguish susceptible from resistant isolates included features particular to each species, even for such a stereotypical response pathway. In fact, recA was the only feature selected as a candidate responsive gene in all five species; lexA and uvrA emerged in four of the five, but no other single transcript was selected in more than three, underscoring the importance of deriving each antibiotic response signature individually.

Importantly, the expression signatures alone merely show that reliable differences occur in the transcriptional response in susceptible versus resistant organisms, while AST requires binary classification of a strain as susceptible or resistant. To address this general classification problem, machine-learning algorithms were deployed (FIG. 5, phase 1), first to identify the most informative transcripts, and second to use these select transcripts to classify unknown isolates. To avoid overtraining, the tested strains were partitioned into a training (derivation) cohort for both feature selection and classifier training, and a testing (validation) cohort as a naïve strain set for assessing classifier performance. ReliefF (Robnik-Šikonja and Kononenko 2003) was used to identify the 10 transcripts whose normalized expression best distinguished susceptible from resistant organisms among the training cohort (FIGS. 6, 14B, 14E; Table 9). Although fewer than 10 transcripts were required to robustly distinguish between the strains thus far tested, more genes were kept in the optimized signature to lessen the potential impact of unanticipated diversity in gene content, sequence, or regulation among clinical isolates.

Figure 6:
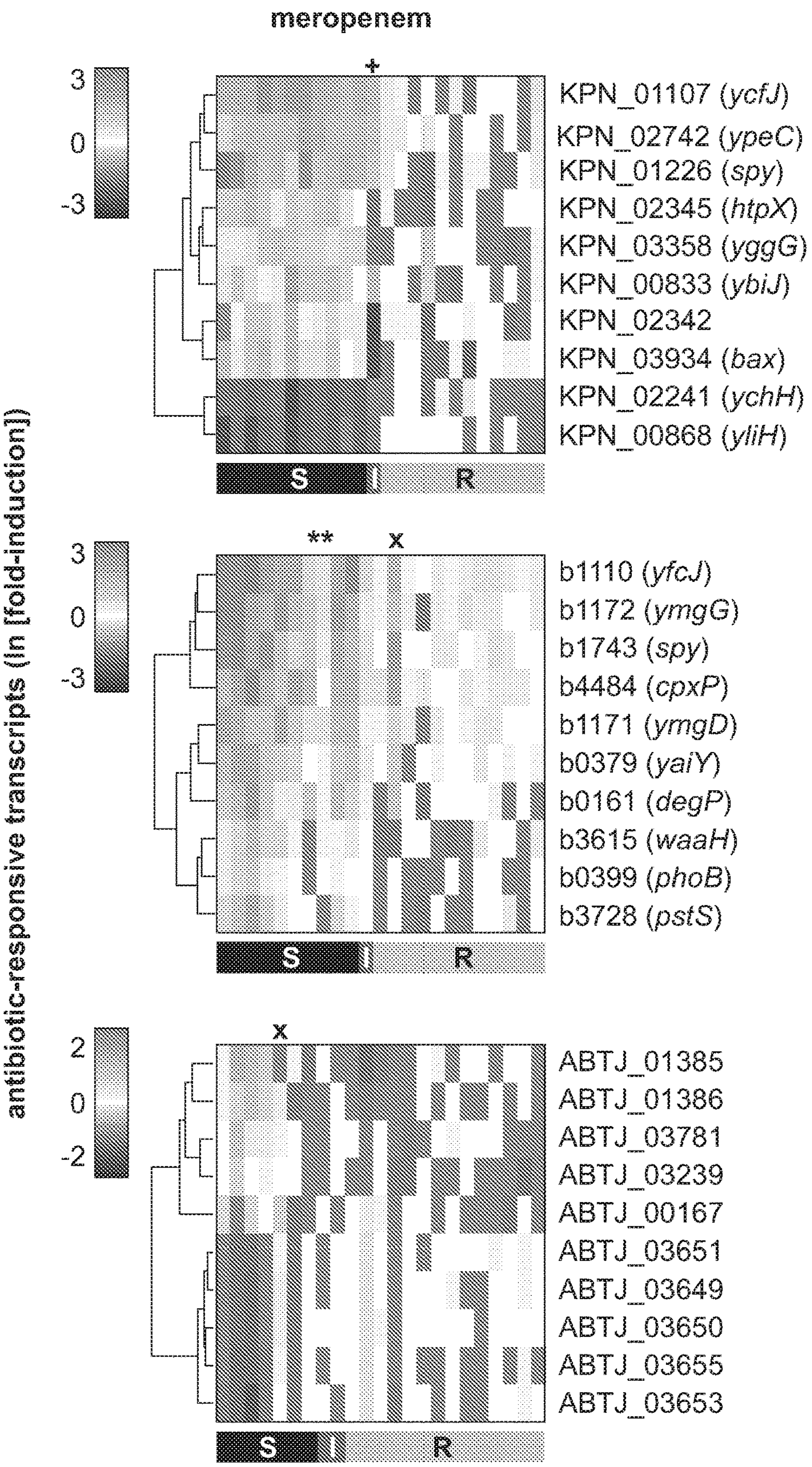
FIG. 6 shows that NanoString® data for top 10 antibiotic-responsive transcripts distinguished susceptible from resistant strains. Heatmaps of normalized, log-transformed fold-induction of top 10 antibiotic-responsive transcripts from 18-24 clinical isolates of *K. pneumoniae* (top), *E. coli* (middle), or *A. baumannii* (bottom) treated at CLSI breakpoint concentrations with meropenem (left), ciprofloxacin (center), or gentamicin (right) are shown, with strains arranged in order of MIC for each antibiotic. Gene identifiers are listed at right, along with gene names if available. CLSI classifications of each strain based on broth microdilution are shown below. *=strains with large inoculum effects in meropenem MIC; +=one-dilution errors; x=strains discordant by more than one dilution.
Figure 6:
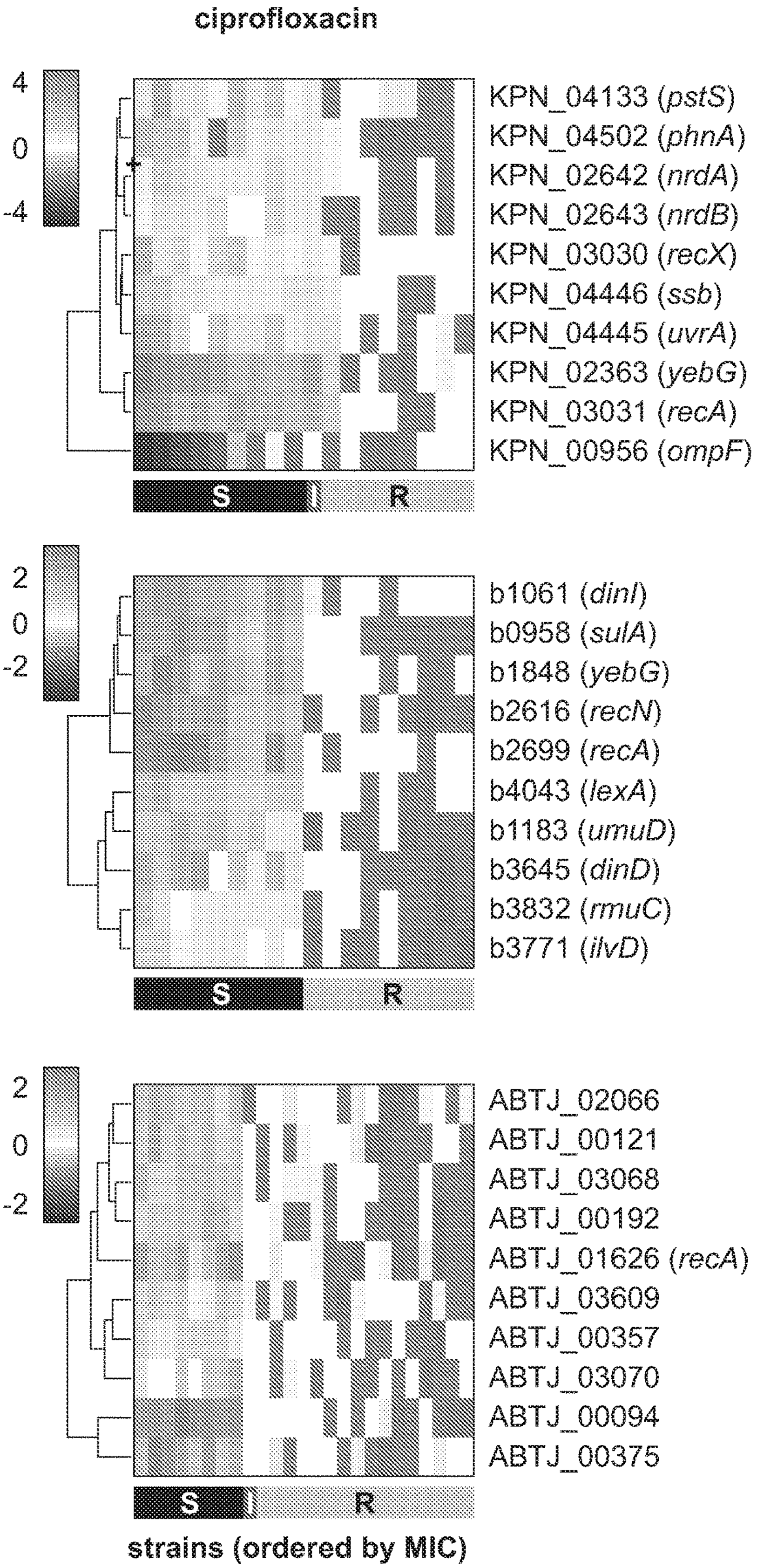
Figure 6:
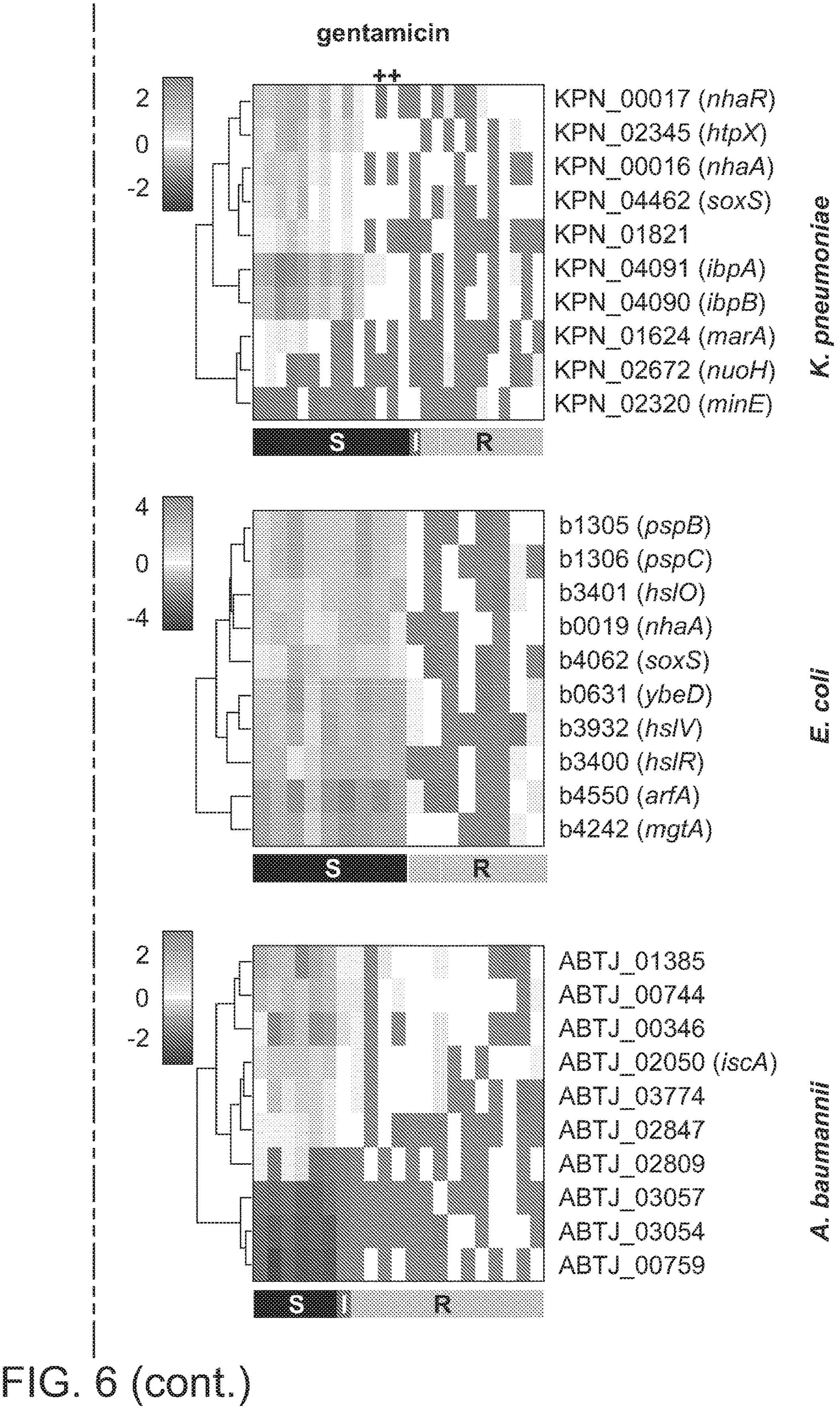
Figure 7A:
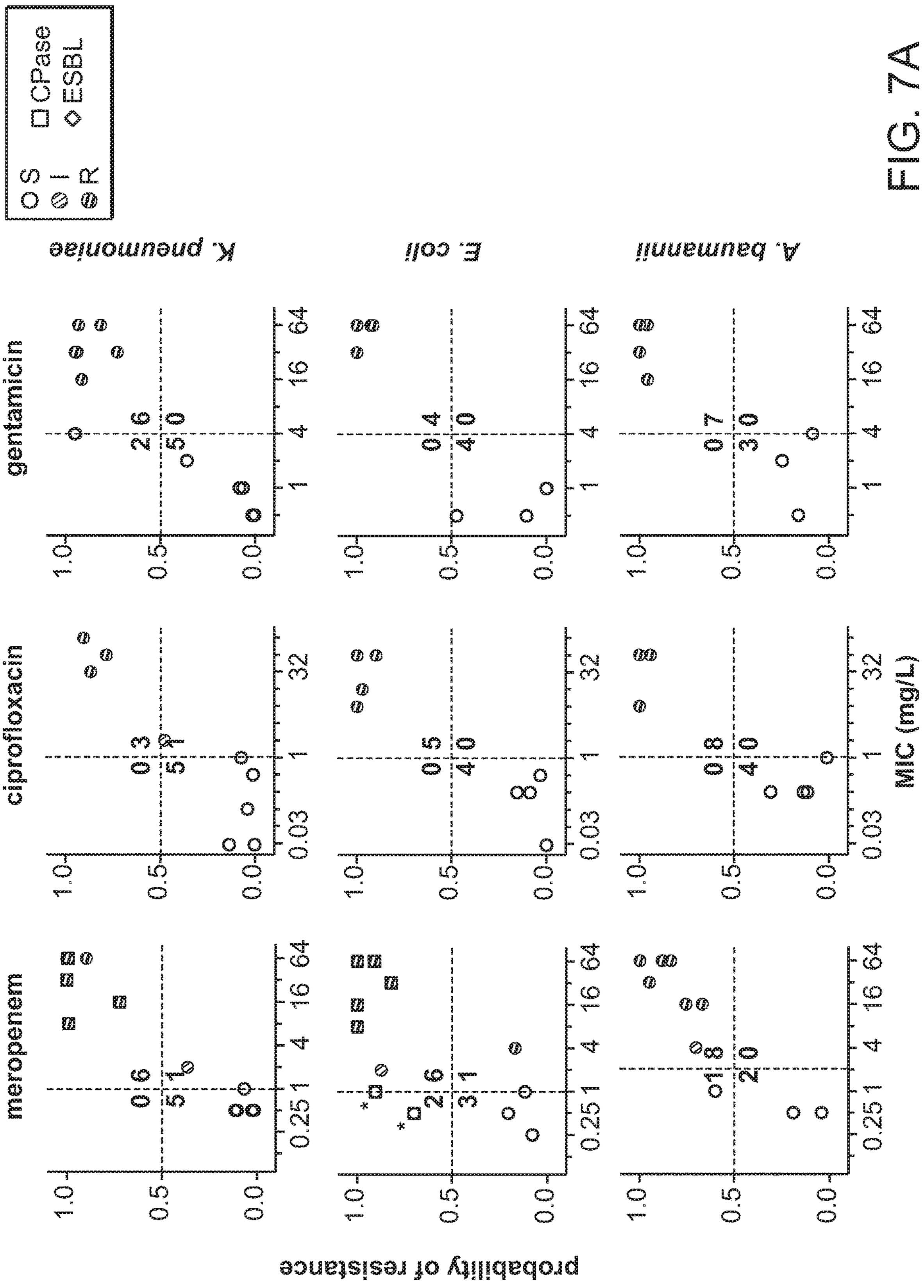
FIGS. 7A and 7B show that GoPhAST-R accurately classified clinical isolates.

Next, an ensemble classifier was trained using the random forest algorithm (Liaw & Wiener) to perform binary classification of isolates in the derivation cohort based solely on these selected features. Finally, this trained classifier was tested on the validation cohort. Across all 11 bacteria-antibiotic combinations, 109 isolates were used as derivation strains for training, and 108 isolates were tested as validation. The ensemble classifier correctly classified 100 of these 108 (93% categorical agreement, 95% confidence interval [CI] 87-96% by Jeffrey's interval (Brown et al.)), including 51 of 52 resistant isolates (1.9% very major error rate, 95% CI 0.21-8.6%) and 35 of 38 susceptible isolates (7.9% major error rate, 95% CI 2.3-20%), compared with standard broth microdilution (FIGS. 7A, 14C, 14F; Table 10). Of note, both categorical agreement and rates of very major and major errors are typically reported on a natural distribution of isolates. In contrast, as disclosed herein, a "challenge set" of isolates was deliberately assembled, one that was intentionally overrepresented for isolates near the clinical breakpoints, which will tend to artificially inflate all errors, since discrepant classifications are more common for strains with MICs near the breakpoint-both due to possible errors in the assay and to one-dilution errors inherent in the gold standard broth microdilution assay (CLSI). Consistent with this, all major and very major errors in Phase 1 testing involved strains less than or equal to two dilutions away from the breakpoint ("+" in FIG. 3). Two apparent major errors exhibited large inoculum effects ("*" in FIG. 6 and FIG. 3, discussed below) in carbapenemase-producing strains reported as resistant by GoPhAST-R but susceptible by standard broth microdiluton. These two likely represent isolates that are misclassified as susceptible by the gold standard method (Anderson et al. 2007; Centers for Disease and Prevention 2009; Nordmann, Cuzon, and Naas 2009; Weisenberg et al. 2009) but correctly recognized as resistant by GoPhAST-R.

Figure 5:
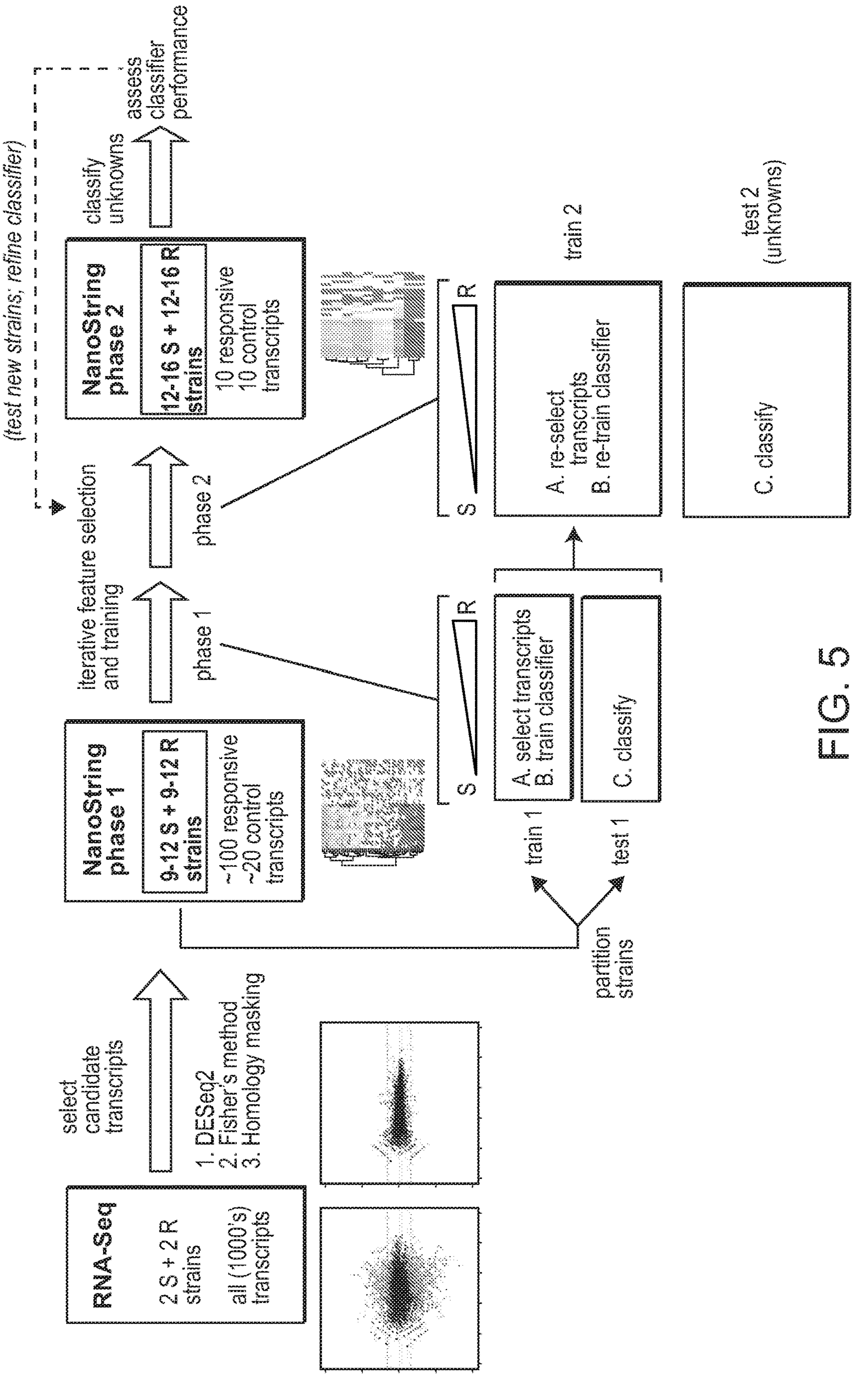
FIG. 5 depicts a schematic of the data analysis scheme of the instant disclosure, including the "two-phase" machine learning approach to feature selection and strain classification employed herein. The schematic representation shows major data analysis steps employed for identifying antibiotic-responsive transcriptional signatures from RNA-Seq data, validating and optimizing these signatures using NanoString® in two phases, and using these signatures to classify strains of unknown MIC, also in two phases. First, candidate antibiotic-responsive and control transcripts were chosen from RNA-Seq data using custom scripts built around the DESeq2 package, and conserved regions of these transcripts were identified for targeting in a hybridization assay. In phase 1 (implemented for all pathogen-antibiotic pairs), these candidate transcripts were quantitated on the NanoString® assay platform, and the resulting data were partitioned by strain into training and testing cohorts. Ten transcripts that best distinguished susceptible from resistant strains within the training cohort were then selected (step 1A) using the reliefF feature selection algorithm (implemented via the CORElearn package), then used to train an ensemble classifier (step 1B) on the same training cohort using a random forest algorithm (implemented via the caret package). This trained classifier was then used to predict susceptibilities of strains in the testing cohort (step 1C), and accuracy was assessed by comparing with broth microdilution results (Table 10). In phase 2 (implemented for *K. pneumoniae*+meropenem and ciprofloxacin), the same process was repeated, but the phase 1 training and testing cohorts were combined into a single, larger training cohort for feature selection (step 2A) and classifier training (step 2B), and a new set of strains was obtained as a testing cohort. The 10 genes selected from the phase 2 training cohort were measured from this phase 2 testing cohort, and the trained classifier was used for AST on these new strains (step 2C), with accuracy again assessed by comparison with broth microdilution (Table 10). See Supplemental Methods for detailed descriptions of each of these analysis steps.
Figure 7B:
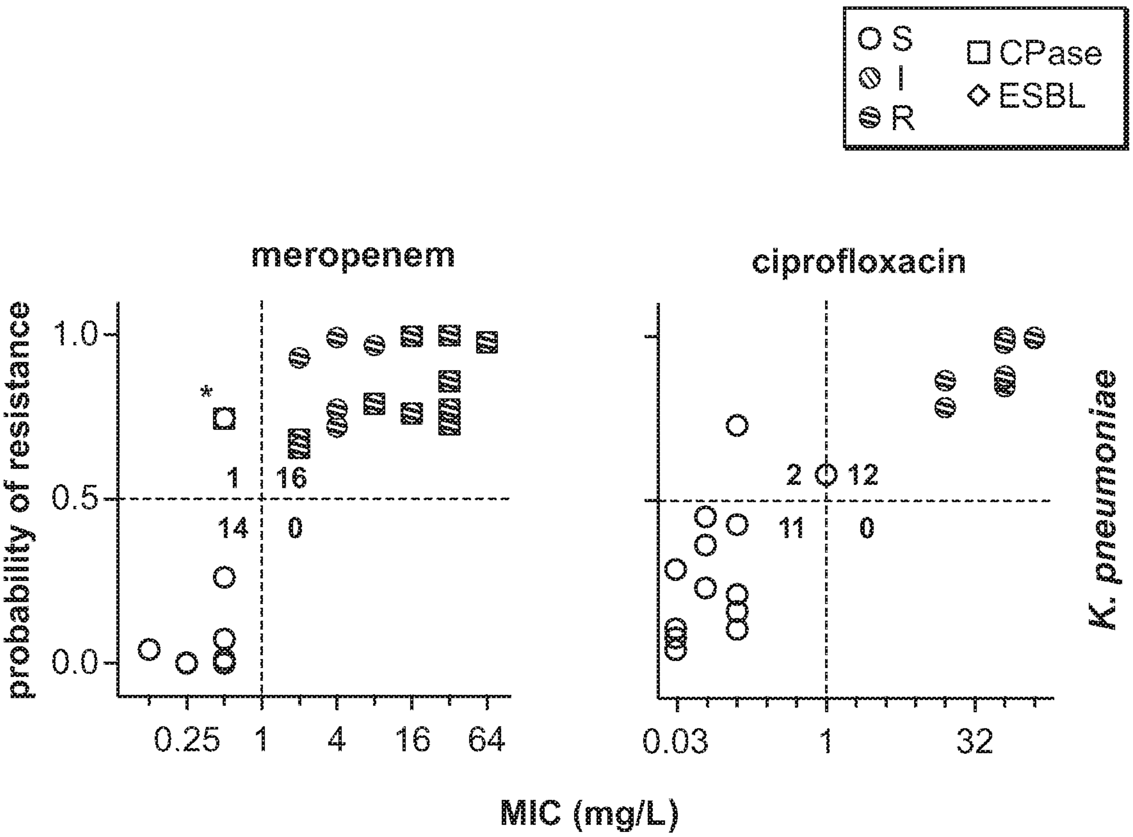
Figure 8:
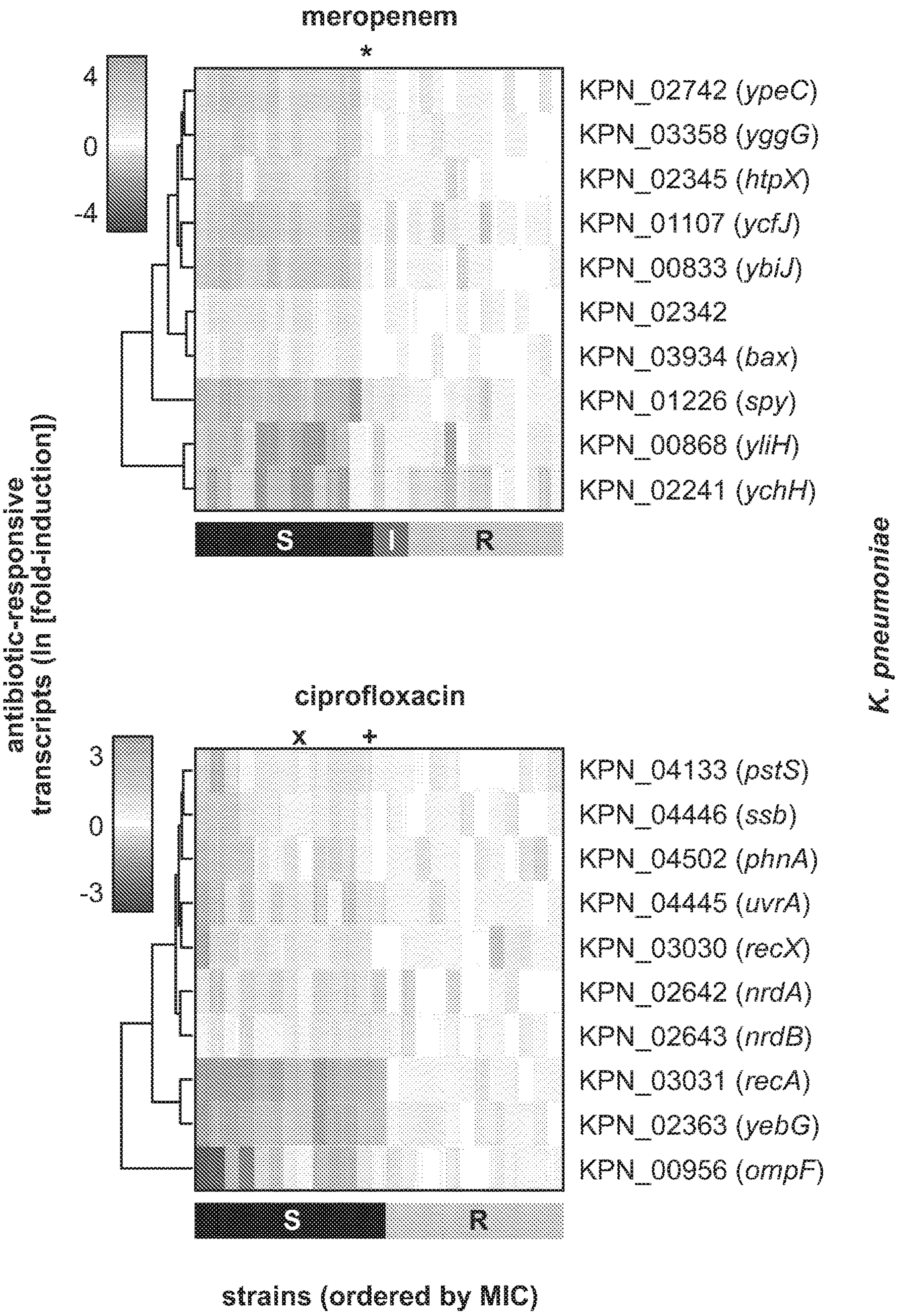
FIG. 8 shows NanoString® data for top 10 antibiotic-responsive transcripts for strains tested in phase 2. Heatmaps of normalized, log-transformed fold-induction of top 10 antibiotic-responsive transcripts observed from 25-31 clinical isolates of *K. pneumoniae* treated at CLSI breakpoint concentrations with meropenem (left) or ciprofloxacin (right) are shown, with strains arranged in order of MIC for each antibiotic. CLSI classifications are shown below. *=strain with large inoculum effects in meropenem MIC; +=one-dilution error; x=strain discordant by more than one dilution. Note that the 10 responsive transcripts shown were the only 10 tested for this second phase of GoPhAST-R implementation.

To assess this approach to classification as it would be deployed on unknown isolates, and to ensure against over-training on the initial set of isolates, a second, iterative round of training was performed on all strains from the initial phase of classification and tested a new set of *Klebsiella pneumoniae* isolates treated with meropenem and ciprofloxacin (FIG. 5, phase 2). The initial derivation and validation cohorts were combined into a single, larger training cohort, on which feature selection was repeated and retrained for the ensemble classifier. The top 10 features chosen in phase 2 were very similar to those chosen in phase 1 (Table 9), with 78% mean overlap in gene content, mean Jaccard similarity coefficient 0.67, and mean Spearman correlation coefficient 0.59 across all pathogen-antibiotic combinations. This refined classifier was then applied to predict susceptibility in a new test set of 25-30 isolates for each antibiotic (FIG. 8), this time measuring only the top 10 selected responsive transcripts, rather than the 60-100 transcripts measured in phase 1. Here, GoPhAST-R correctly classified 52 of 55 strains (95% categorical agreement, 95% CI 86-98%) (FIG. 7B), including all 25 resistant isolates (0% very major error rate, 95% CI 0-9.5%) and 25 of 27 susceptible isolates (7.4% major error rate, 95% CI 1.6-22%), compared with broth microdilution. One of the three discrepant isolates is only one dilution from the breakpoint (FIG. 8), and another exhibits a large inoculum effect (FIG. 8) in a carbapenemase-producing strain that was reported as resistant by GoPhAST-R, likely the same phenomenon described above.

Three isolates classified as meropenem-resistant by GoPhAST-R but susceptible by broth microdilution exhibited a large inoculum effect. These three isolates, a *K. pneumoniae* (BAA2524) and two *E. coli* (BAA2523 and AR0104), all had MICs of 0.5-1 mg/L on standard broth microdilution with an inoculum of $10^5$ cfu/mL, but MICs of ≥32 mg/L with an inoculum of $10^7$ cfu/mL. Each of these strains carried a carbapenemase gene: BAA2523 and BAA2524 contained $bla_{OXA\text{-}48}$, and AR0104 contained $bla_{kPC\text{-}4}$, as has been reported for other such strains with large inoculum effects (Adams-Sapper et al. 2015; Adler et al. 2015). While the clinical consequences of such large inoculum effects are uncertain, they may portend clinical failure (Paterson et al. 2001), particularly in the setting of carbapenemase production (Weisenberg et al. 2009); detection of this phenomenon is a known gap in standard broth microdilution assays (Humphries, R. M.) because they are performed at the lower inoculum (Smith and Kirby 2018; Wiegand, Hilpert, and Hancock 2008). GoPhAST-R recognized these strains as resistant, perhaps because the assay was performed at higher cell density (>$10^7$ cfu/mL), whereas conventional methods missed these CREs.

Importantly, the ability of the classifier disclosed herein to accurately call a strain susceptible or resistant was independent of resistance mechanism, as exemplified for meropenem resistance. In total, 22 of 47 meropenem-resistant isolates, including 7 of 22 *K. pneumoniae,* 4 of 12 *E. coli*, and 11 of 13 *A. baumannii*, lacked carbapenemases (Table 7; Cerqueira et al. 2017; (www)cdc.gov/ARIsolateBank/), yet 46 of these 47 isolates were correctly recognized as resistant by GoPhAST-R. These results underscore the ability of GoPhAST-R to assess phenotypic resistance, agnostic to its genotypic basis.

Example 6: Combining Genotypic and Phenotypic Information in a Single Assay Improves Accuracy in Carbapenem Resistance Detection and Enables Molecular Epidemiology Since GoPhAST-R involves multiplexed, hybridization-based RNA detection, the techniques herein can readily accommodate simultaneous profiling of additional transcripts, including genetic resistance determinants such as carbapenemases. GoPhAST-R can thus provide valuable epidemiological data as well as resolve discrepancies between phenotype-based detection and standard broth dilution methods by providing genotypic information. For example, in the three cases with discrepant classifications and prominent inoculum effects, each isolate carried a carbapenemase gene. By incorporating probes to simultaneously detect resistance determinants such as carbapenemase genes, the genotypic component of GoPhAST-R can provide complementary evidence to reinforce its phenotypic call of resistance. This can be critical for the complex case of CRE detection (Anderson et al. 2007; Arnold et al. 2011; Centers for Disease and Prevention 2009; Gupta et al. 2018; Nordmann, Cuzon, and Naas 2009; Weisenberg et al. 2009): even the American Type Culture Collection, the source of archived strains BAA2523 and BAA2524, recognized this discrepancy in AST, noting that these carbapenemase-producing isolates were reported as susceptible upon deposition but tested resistant by other methods (ref: ATCC pdf comments (see e.g., World Wide Web at (www)atcc.org/~/ps/BAA-2523.ashx).

Indeed, the most common known mechanism for carbapenem resistance among the Enterobacteriaceae involves the acquisition of one of several known carbapenemase genes (see e.g., Woodworth et al. 2018), most commonly the KPC, NDM, OXA-48, IMP, and VIM families (Martinez-Martinez and Gonzalez-Lopez 2014; Nordmann, Dortet, and Poirel 2012). Thus, probes were incorporated for these carbapenemases into the GoPhAST-R assay for meropenem AST, as well as two extended-spectrum beta-lactamase (ESBL) gene families that have been associated with carbapenem resistance when expressed in the context of porin loss-of-function, CTX-M-15 (Canton et al.; Cubero et al.) and OXA-10 (Ma et al. 2018) (Table 9). Of note, conventional PCR-based detection of the IMP and VIM gene families has been challenging because of their genetic diversity (Kaase et al.) and the relative intolerance of PCR to point mutations in primer binding sites, especially towards 3' end of the primer (Paterson et al.; Klungthong et al.). In contrast, hybridization is more tolerant to point mutations and is amenable to a multiplexed format that allows the inclusion of multiple probes to recognize different regions of the same target, and thus identify targets with greater diversity. For instance, the currently disclosed GoPhAST-R includes 4 separate probe pairs to increase robustness of IMP detection (Table 9; see section below on Homology Masking).

Figure 9A:
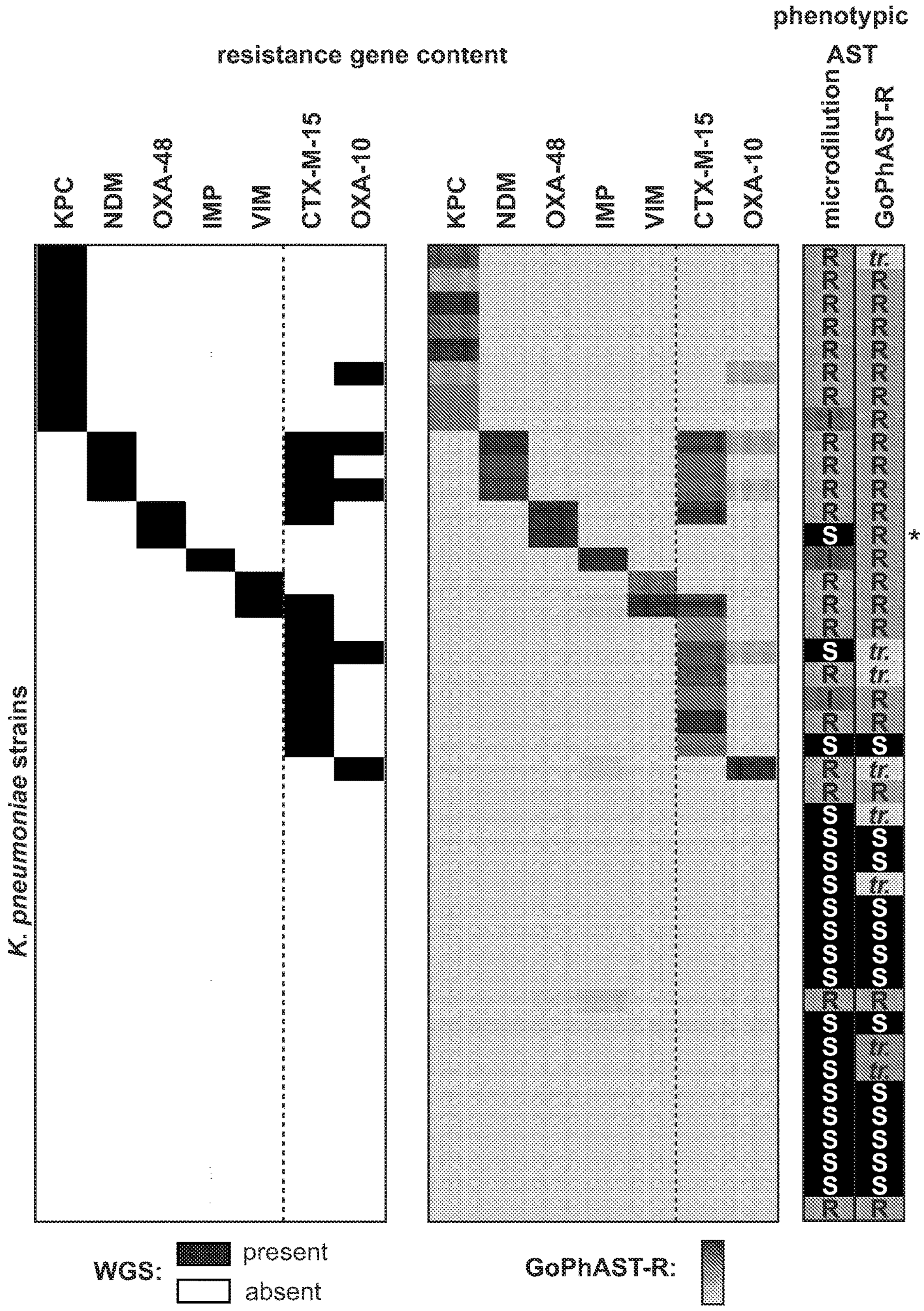
FIGS. 9A-9C show that GoPhAST-R detected carbapenemase and ESBL gene content from tested strains. Known carbapenemase and select ESBL transcript content based on WGS data (left panels) were compared with heatmaps of GoPhAST-R results (right panels) for all *K. pneumoniae* (FIG. 9A), *E. coli* (FIG. 9B), and *A. baumannii* (FIG. 9C) isolates tested for meropenem susceptibility for which WGS data were available. Heatmap intensity reflects normalized, background-subtracted, log-transformed NanoString® data from probes for the indicated gene families. Vertical dashed line separates carbapenemases (left) from ESBL genes (right). Phenotypic AST classification by broth microdilution and GoPhAST-R is shown at right ("S"=susceptible, "I"=intermediate, "R"=resistant; "tr."=strain used in training cohort, thus not classified by GoPhAST-R). *=strains with large inoculum effects in meropenem MIC; x=strain discordant by more than one dilution.
Figure 9B:
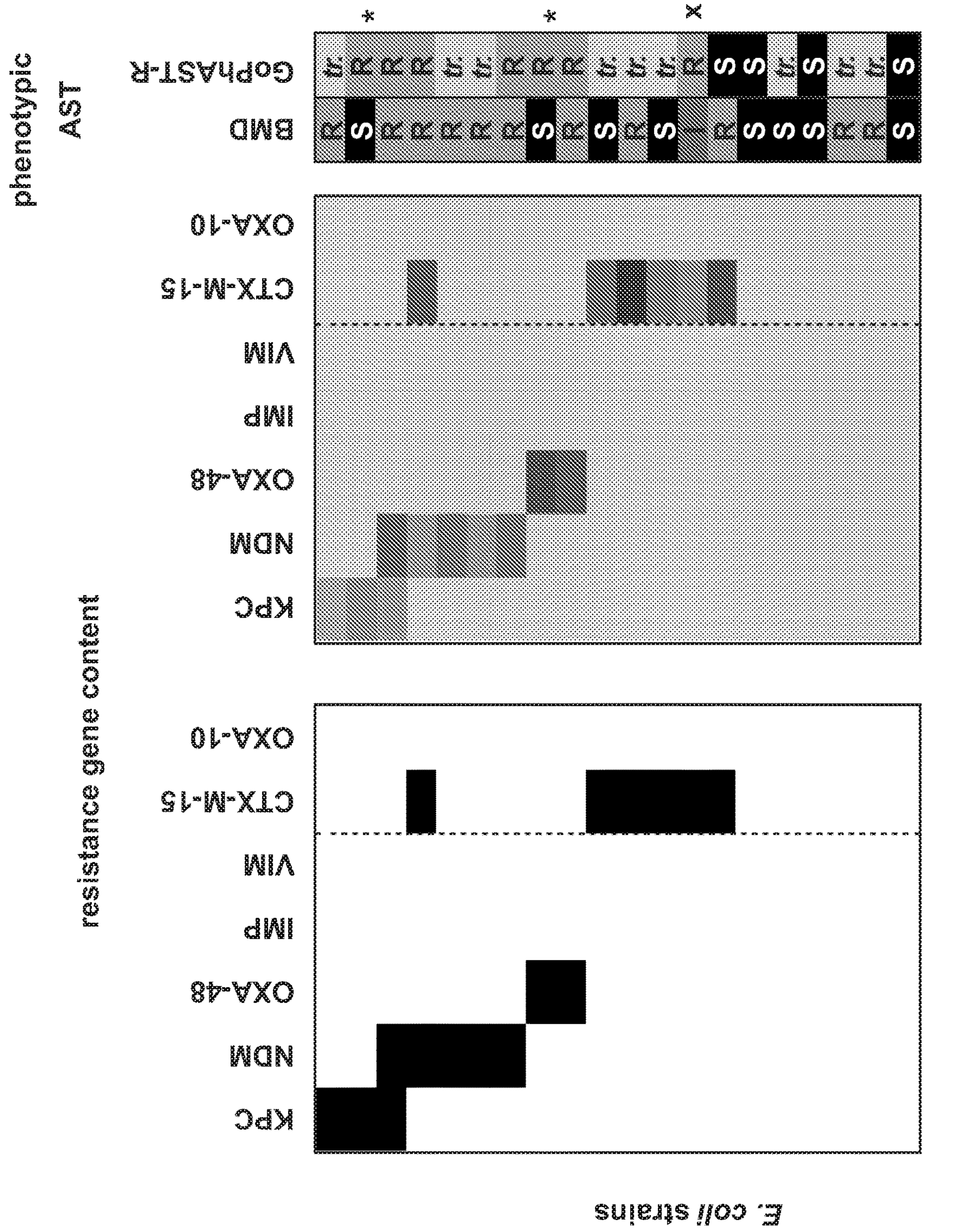
Figure 9C:
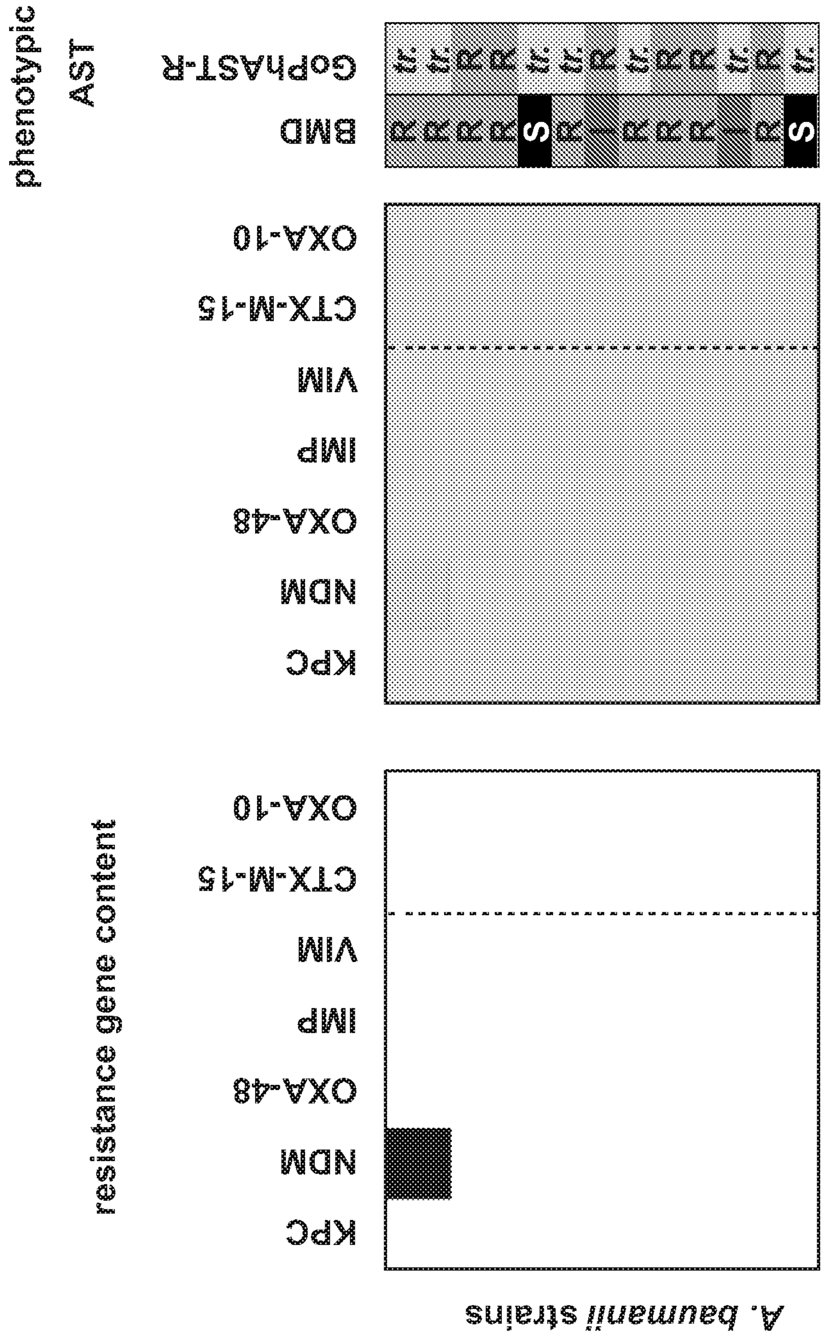

GoPhAST-R detected all 39 carbapenemase genes across 38 strains known to be present by WGS, including at least one member of each of the five targeted classes, and all 29 ESBL genes across 26 strains; no signal was detected in the 25 meropenem-resistant strains nor the 38 susceptible isolates known to lack these gene families, across all three species (FIGS. 9A-9C; Table 7). This included detection of OXA-48 or KPC in the three cases of discrepant phenotypic AST classification and prominent inoculum effects. Thus, in a single assay, GoPhAST-R can provide both phenotypic AST and genotypic information about resistance mechanism.

Figure 10:
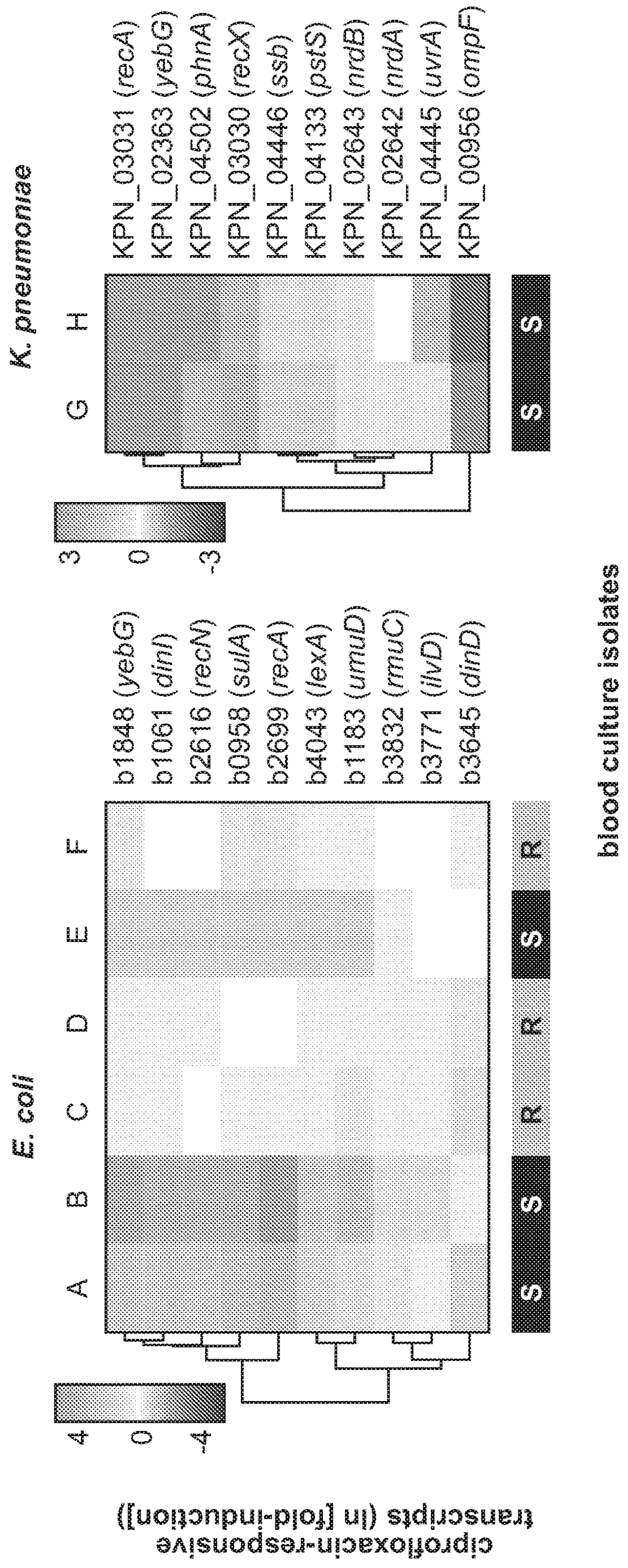
FIG. 10 shows that GoPhAST-R detected antibiotic-responsive transcripts directly from positive blood culture bottles. Heatmaps are shown of normalized, log-transformed fold-induction of the top 10 ciprofloxacin-responsive transcripts from 8 positive blood culture bottles that grew either *E. coli* (6 strains, A-F) or *K. pneumoniae* (2 bottles, G-H). CLSI classifications of isolates, which were blinded until analysis was complete, are displayed below each heatmap.
Figure 11A:
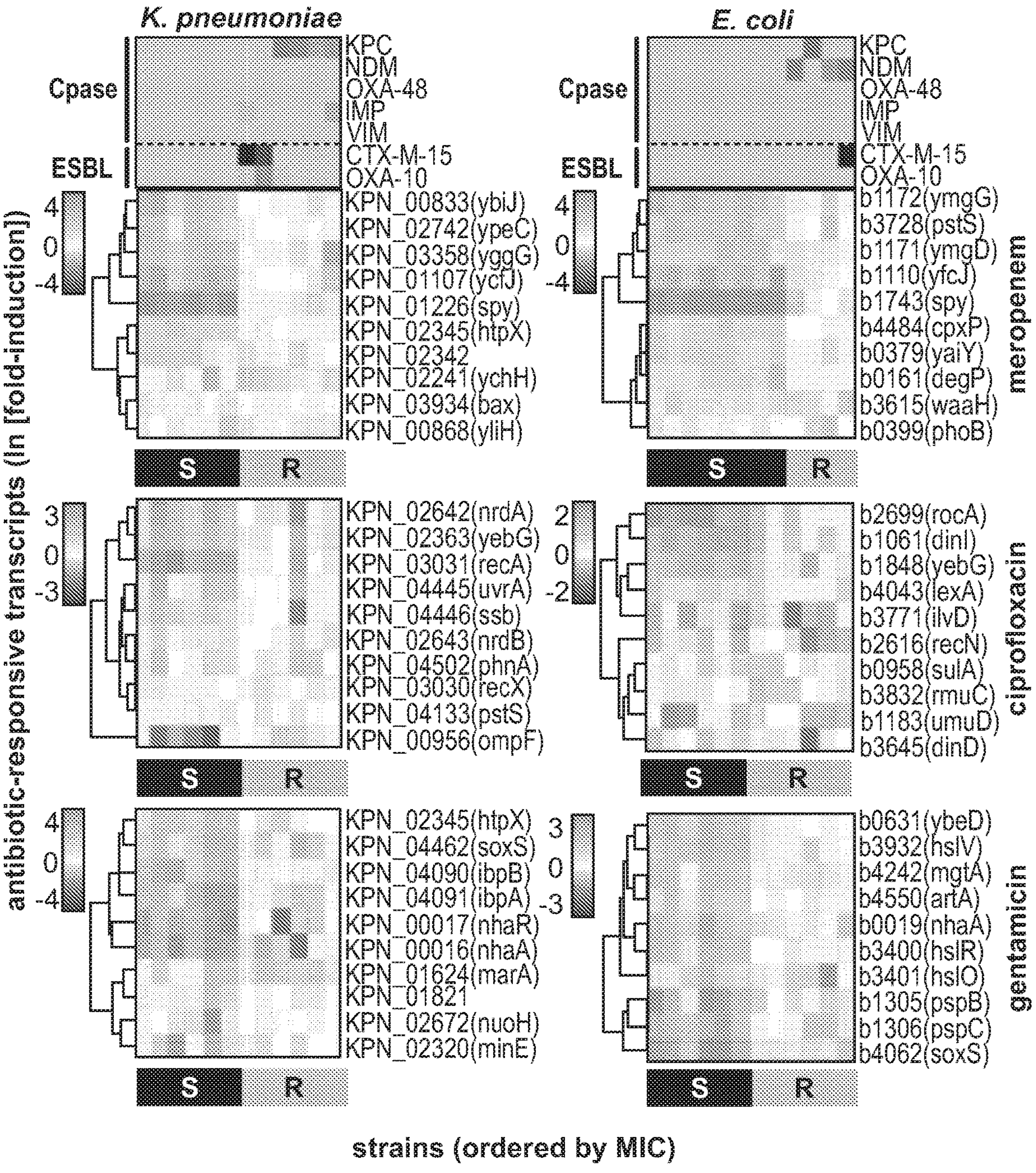
FIGS. 11A and 11B show that GoPhAST-R accurately classified AST and detected key resistance elements directly from simulated positive blood culture bottles in <4 hours.
Figure 11B:
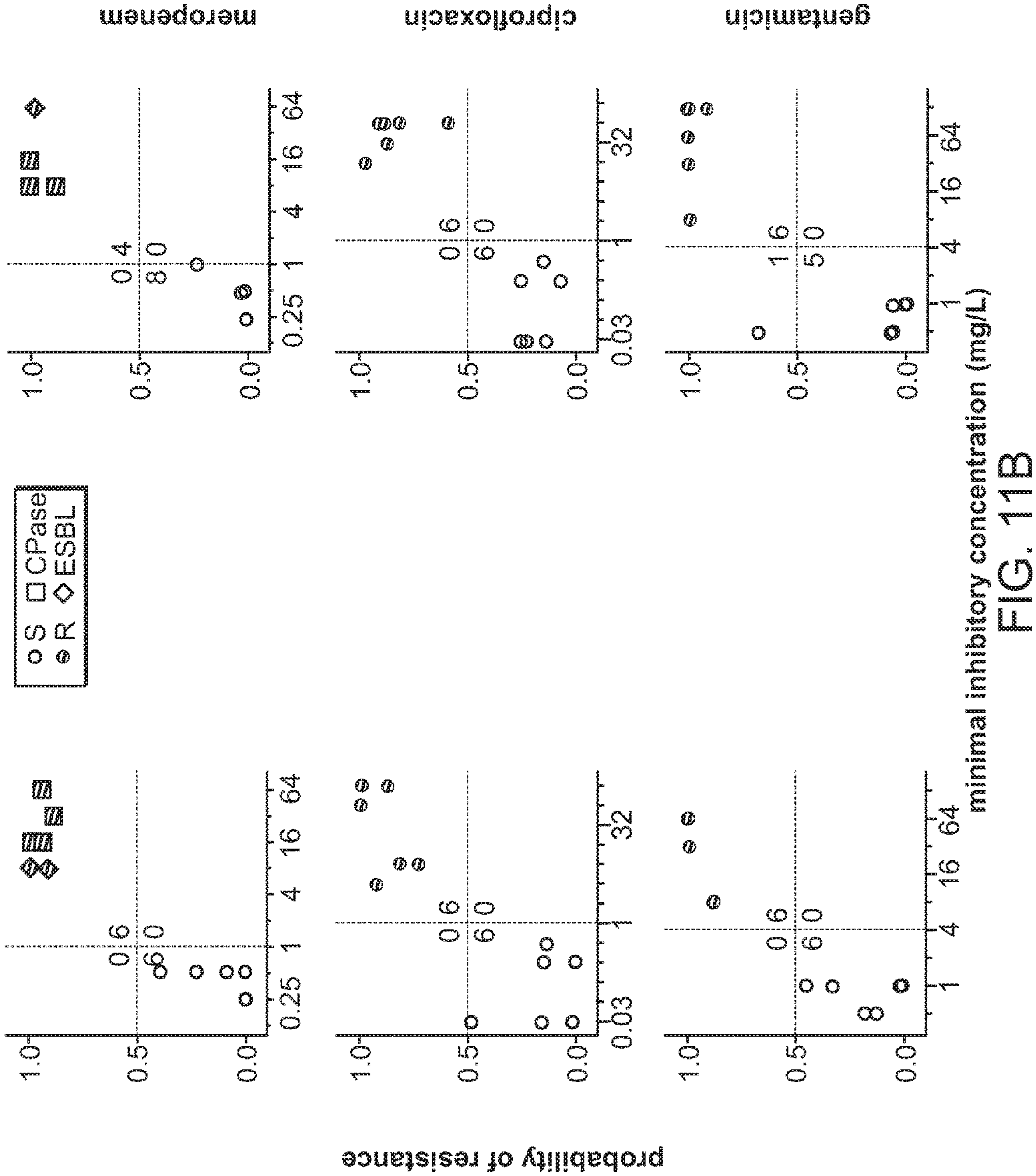

Example 7: GoPhAST-R can Measure Antibiotic Susceptibility Directly from Positive Blood Culture Bottles Previous work had demonstrated that a simulated positive blood culture bottle contains sufficient bacteria to permit mRNA detection (Hou et al. 2015). To demonstrate one clinical application, GoPhAST-R was used to rapidly determine ciprofloxacin susceptibility in blood culture bottles that grew gram-negative rods from the MGH clinical microbiology laboratory. Ciprofloxacin was chosen because no rapid genotypic method exists for detection of fluoroquinolone resistance due to the diversity of genetic alterations that can cause fluoroquinolone resistance, and because of the relative prevalence of fluoroquinolone resistance, making it feasible to acquire both sensitive and resistant cases. Six clinical *E. coli* and two *K. pneumoniae* positive blood cultures were tested (FIG. 10) and the techniques herein made it possible to clearly distinguish three susceptible from three resistant *E. coli*; both *K. pneumoniae* species were susceptible. Given the relative scarcity of gentamicin and meropenem resistant isolates available for the instant studies, to test assay performance in this growth format, simulated positive blood cultures were generated by spiking in susceptible or resistant isolates of *K. pneumoniae* and *E. coli*. GoPhAST-R detected optimized transcriptional signatures for each pathogen/antibiotic pair directly from these positive blood culture bottles (FIG. 11A), and AST prediction using a random forest model and leave-one-out cross-validation (Efron & Gong) (FIG. 11B) correctly classified 71 of 72 blood cultures (99% categorical agreement with broth microdilution, 95% CI 94-100%), including 0% very major error rate (31 of 31 resistant isolates classified correctly; 95% CI 0-7.7%) and 2.6% major error rate (37 of 38 susceptible isolates classified correctly; 95% CI 0.29-11%).

Figure 12A:
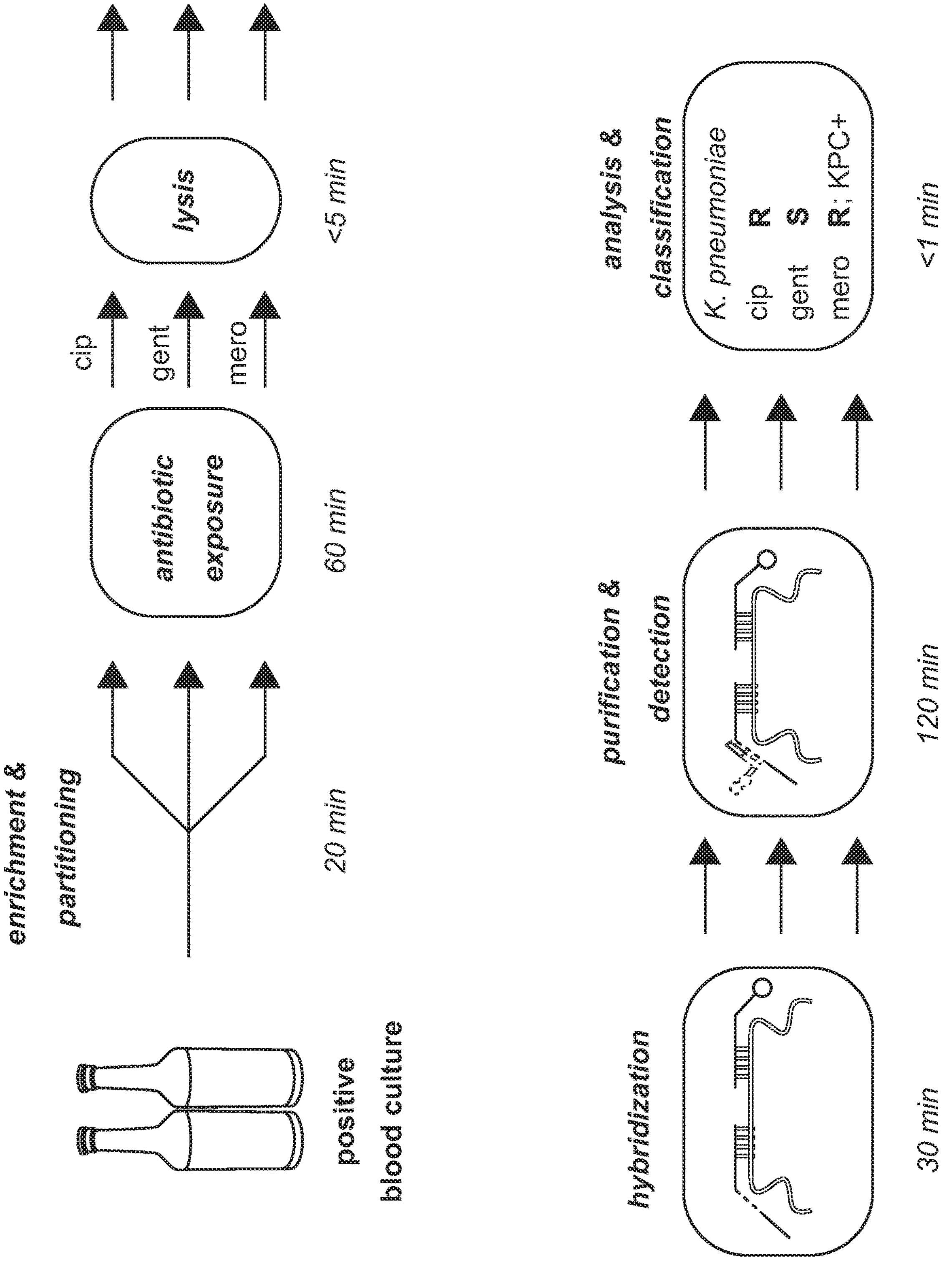
FIGS. 12A and 12B show for an exemplary GoPhAST-R workflow that the NanoString® Hyb & Seq™ platform distinguished phenotypically susceptible from resistant strains and detected genetic resistance determinants in <4 hours.
Figure 12B:
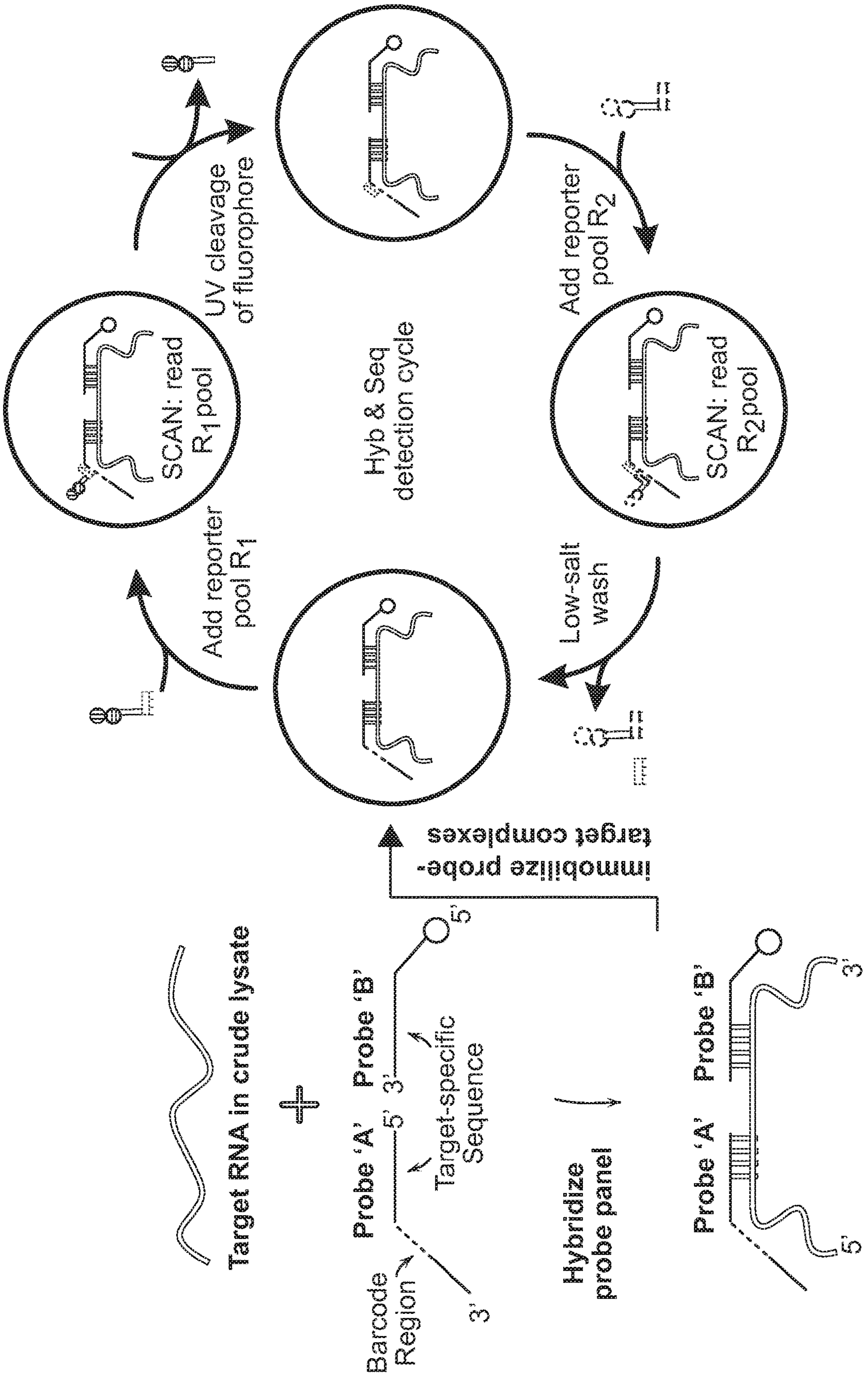
Figure 12B:
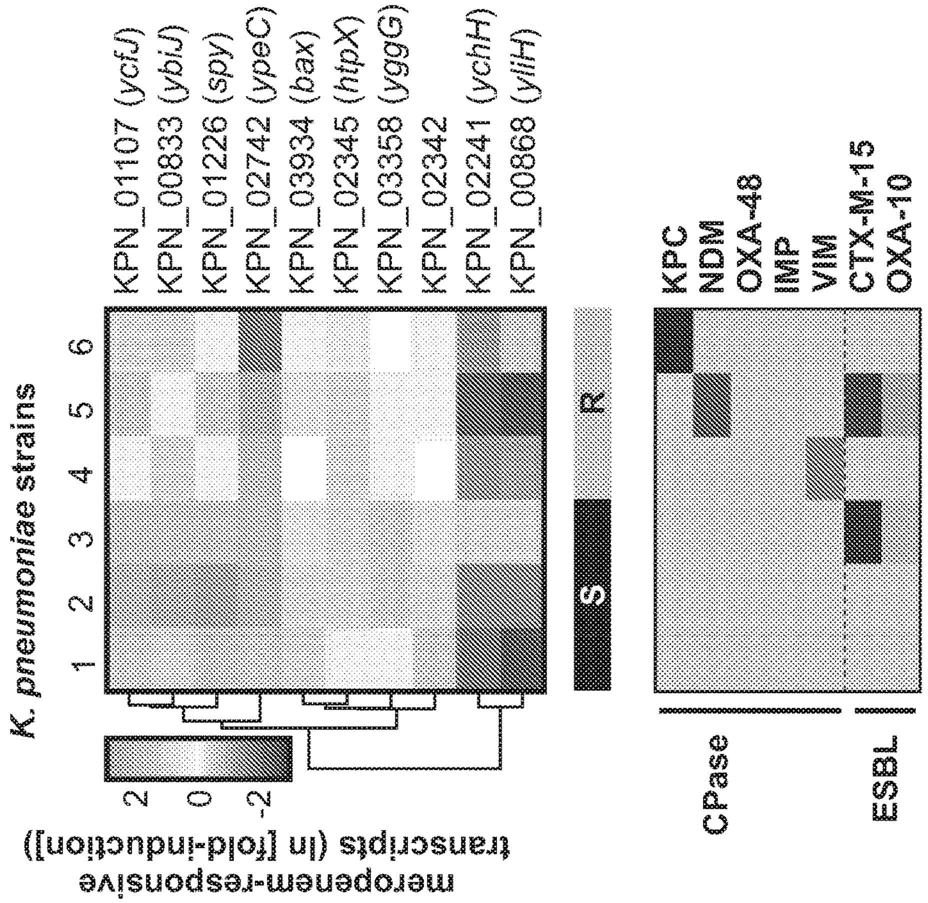
Figure 13A:
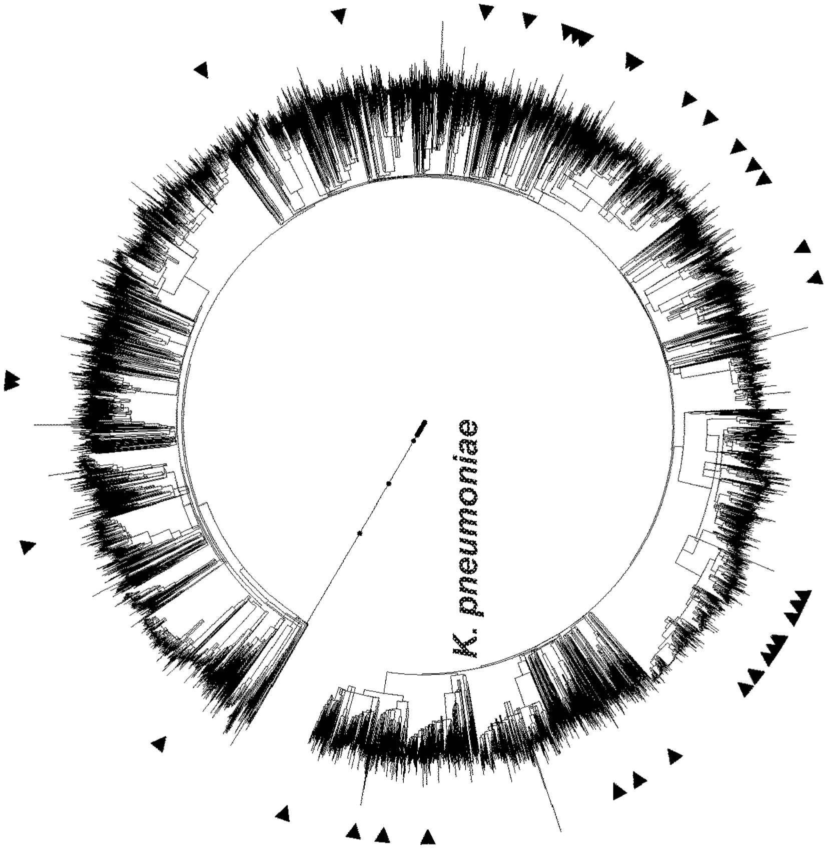
FIGS. 13A-13D show phylogenetic trees that highlight the diversity of strains used in that instant disclosure.
Figure 13B:
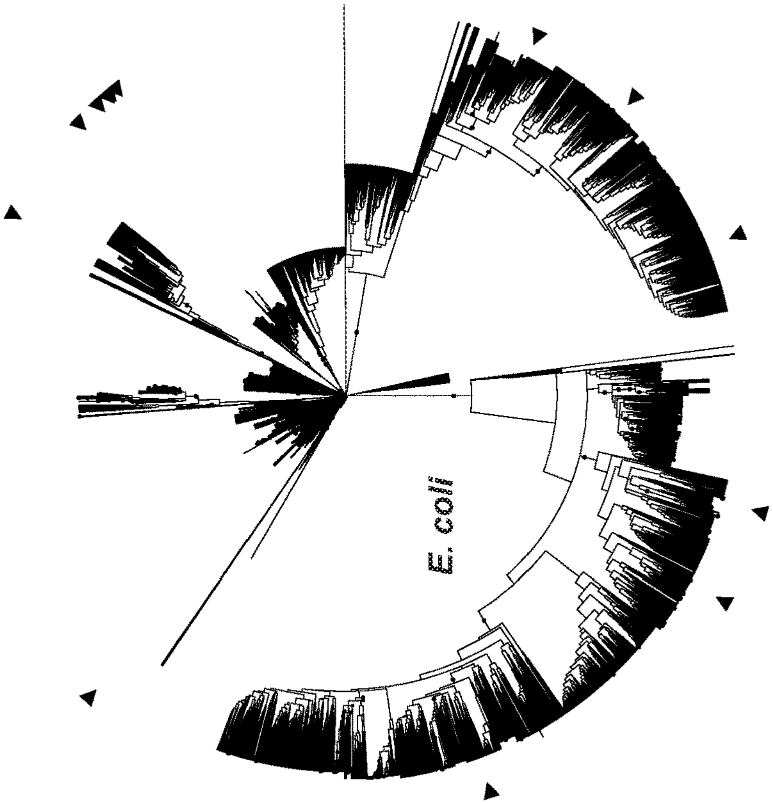
Figure 13D:
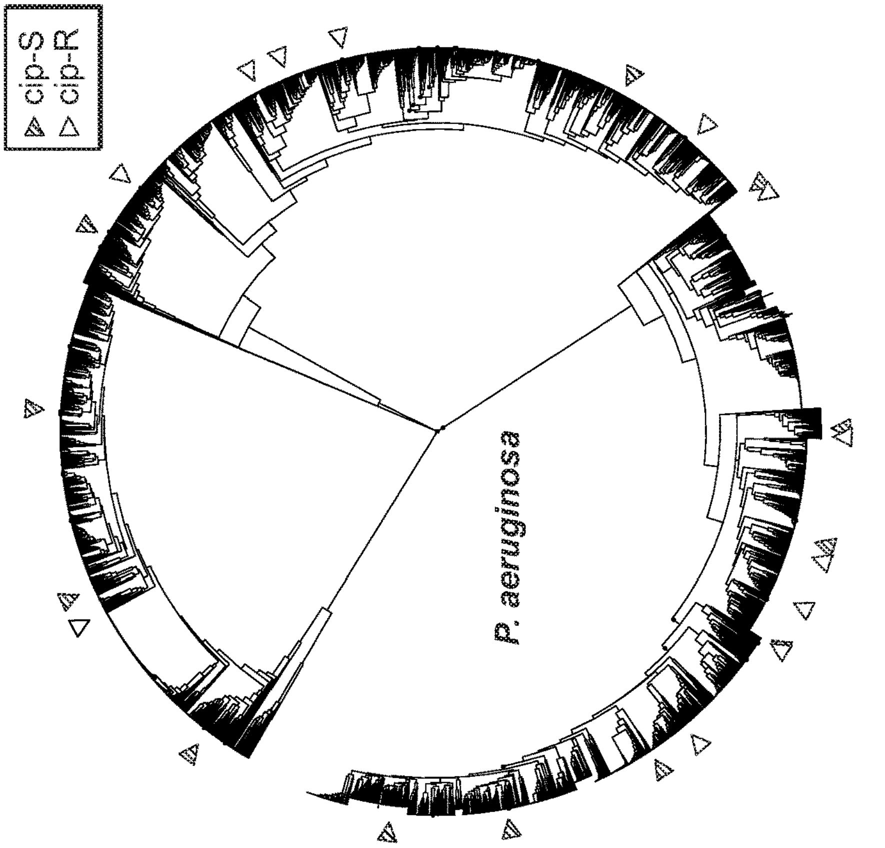
Figure 13C:
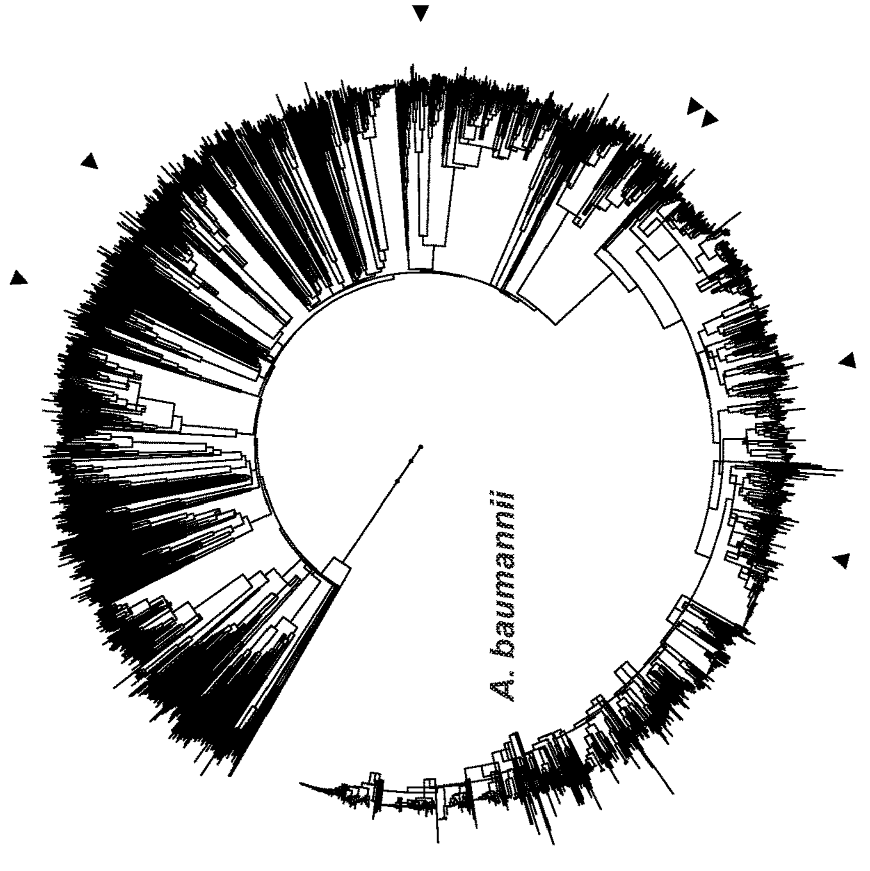

Example 8: A Next-Generation NanoString® Detection Platform, Hyb & Seq™, Accelerates GoPhAST-R to <4 Hours GoPhAST-R was deployed on an exemplary next-generation nucleic detection platform, NanoString® Hyb & Seq™ (J. Beechem, AGBT Precision Health 2017), that features accelerated detection technology, thus enabling AST in <4 hours (FIG. 12A). Relative to the nCounter detection platform, Hyb & Seq™ (FIG. 12B, left panel) enables accelerated hybridization by utilizing unlabeled reporter probes that are far smaller and thus equilibrate far faster than the standard nCounter probes, which are covalently attached to a bulky set of fluorophores during hybridization. Accelerated optical scanning enables fluorescent barcoding of these smaller reporter probes via sequential cycles of binding, detection, and removal of complementary barcoded fluorophores (FIG. 12B, middle panel; see Methods). On a prototype Hyb & Seq instrument, GoPhAST-R can measure expression signatures to determine antibiotic susceptibility in <4 hours, as demonstrated with *K. pneumoniae* for both phenotypic meropenem-responsive transcriptional signatures and detection of carbapenemase and select beta-lactamase genes (FIG. 12B, right panel). A head-to-head time trial on simulated blood culture bottles demonstrated GoPhAST-R results in <4 hours from the time of culture positivity, compared with 28-40 hours in the MGH clinical microbiology laboratory by standard methods, which entailed subculture followed by AST determination on a VITEK-2.

As discussed herein, fast, accurate antibiotic susceptibility testing is a critical need in the battle against escalating antibiotic resistance. Advantageously, the ability of the presently disclosed AST assays to be conducted in hours instead of days can inform decisions on antibiotic administration closer to real-time, which may both improve individual patient outcomes (Kumar et al. 2006) and minimize needless use of broad-spectrum antibiotics for susceptible organisms (Maurer et al.). Growth-based assays are fundamentally limited in speed by the doubling time of the pathogen, and genotypic assays are limited by the inability to comprehensively define the ever-growing diversity and complexity of bacterial antibiotic resistance mechanisms. At least in part by quantifying a refined set of transcripts whose antibiotic-induced expression reflects susceptibility, GoPhAST-R provides a conceptually distinct approach to rapid phenotypic antibiotic resistance detection, agnostic to resistance mechanism and extendable to any antibiotic class, while simultaneously providing select, complementary genotypic information that can both improve the accuracy of phenotypic classification and provide valuable epidemiologic data for identifying the emergence and tracking the spread of resistance. Considering the widespread adoption of rapid pathogen identification by matrix-associated laser desorption and ionization/time-of-flight (MALDI-TOF) mass spectrometry in 2 hours from subcultured colonies streaked from blood culture bottles (Florio et al.; Tanner et al.; Perez et al.), this comparatively more informative AST assay directly from blood culture bottles in <4 hours promises to be transformative. Probes have been designed herein to target regions conserved across all sequenced members of their parent species, thereby allowing each probeset to encode species identity in its reactivity profile. Since the NanoString® platform described herein can multiplex up to 800 probes in a single assay (Geiss et al.), the actual deployed test is expected to combine all 20 probes used for each pathogen-antibiotic pair (Table 9) into a single multi-species probeset for each antibiotic, thereby providing simultaneous pathogen identification along with AST. Alternatively, it is expected that species can be identified prior to AST on the same NanoString® platform using a more sensitive rRNA-based assay (Bhattacharyya et al.). The machine learning approach to strain classification developed for GoPhAST-R provides actionable information in excellent categorical agreement with the gold standard broth microdilution assay and should continue to improve in accuracy as it is trained on an increasing number of strains. Taken all together, omitting carbapenemase-producing strains with ambiguous and likely errant susceptible classification by the gold standard assay, GoPhAST-R correctly classified 100 of 106 strains (94%) in phase 1 and 52 of 54 strains (96%) in phase 2, as well as 71 of 72 (99%) simulated blood cultures, with 8 of the 9 discrepancies occurring on strains within two dilutions of the clinical breakpoint.

By integrating genotypic and early phenotypic information in a single rapid, highly multiplexed RNA detection assay, GoPhAST-R offers several advantages over the current gold standard that are unique among other rapid AST assays under development. First, like other phenotypic assays, it determines susceptibility agnostic to mechanism of resistance, a clear advantage over genotypic AST assays. Second, combining genotypic and phenotypic information enhances AST accuracy over conventional growth-based methods. This combined approach notably improves sensitivity of resistance detection in certain cases such as carbapenemase-producing Enterobacteriaceae that test susceptible by standard methods but may rapidly evolve resistance upon treatment (see e.g., Anderson et al. 2007; Arnold et al. 2011; Centers for Disease and Prevention 2009; Gupta, V. et al. 2018; Nordmann, Cuzon, and Naas 2009; Weisenberg et al. 2009). Third, the identification of carbapenem resistance determinants can guide antibiotic choice for some resistant isolates, as certain novel beta-lactamase inhibitors like avibactam or vaborbactam will overcome some classes of carbapenemases (e.g., KPC) but not others (e.g., metallo-beta-lactamases such as the NDM class) (Lomovskaya et al.; Marshall et al.; van Duin & Bonomo). Solely phenotypic assays would currently require additional, serial testing to provide this level of guidance. Fourth, the ability to track resistance determinants in conjunction with a phenotypic assay enables molecular epidemiology without requiring additional testing for use in local, regional, national, or global tracking. The techniques herein demonstrate this advantage for one major class of high-value resistance determinants, the carbapenemases (Woodworth et al. 2018); this combined approach can be extended readily to other critical emerging resistance determinants, such as mcr genes, plasmid-borne colistin resistance determinants recently found in the Enterobacteriaceae (Caniaux et al. 2017; Liakopoulos et al. 2016; Liu et al. 2016; Sun et al. 2018), or even to detect the presence of key bacterial toxins such as Shiga toxin (Rasko et al. 2011) in seamless conjunction with a phenotypic AST assay. Fifth, strains with unknown mechanism of resistance, such as CREs without carbapenemases, can be immediately identified from a single assay; such isolates could be flagged for further study such as WGS if desired. Sixth, the graded relationship between transcriptional response and MIC (FIGS. 14B and 14E) underscores the biology that underpins the strategy: the more susceptible the strain, the greater its transcriptional response to antibiotic exposure. This relationship allows GoPhAST-R to be informed by clinical breakpoint concentrations, thus leveraging decades of careful study linking in vitro strain behavior to clinical outcomes (CLSI). This relationship also explains why the majority of discrepancies between GoPhAST-R and broth microdilution occurred on strains with MICs close to the breakpoint. By contrast, the inability to map to MIC is considered a liability of genotypic assays, including WGS (Ellington et al.). Finally, as a hybridization-based assay, GoPhAST-R will tolerate mutation in its detection targets more robustly than PCR-based assays (see e.g., Klungthong et al. 2010; Paterson, Harrison, and Holmes 2014). This enables GoPhAST-R to more readily detect resistance determinants with marked sequence variation such as the IMP family of carbapenemases, which is challenging to detect by PCR (Kaase et al. 2012). The phenotypic portion of the assay is particularly robust to sequence variation, both because it incorporates the behavior of multiple targets to provide redundancy, and because it measures fold-induction of the target gene by antibiotic, so a target gene that has mutated beyond recognition would not inform AST classification when registered as absent.

The instant disclosure has therefore provided an important proof of principle of a new approach to AST, for expected application to clinical practice. Genetic diversity within a species poses a fundamental challenge to the generalizability of bacterial molecular diagnostics, including transcription-based assays (Wadsworth et al.). The instant GoPhAST-R technique addresses this crucial challenge in a number of ways. First, for each pathogen-antibiotic pair, GoPhAST-R is trained and tested on a geographically and phylogenetically diverse set of strains: strains in the instant disclosure were obtained from multiple geographic regions that sample across the entire phylogeny of each species (FIGS. 13A-13D), notably including the CDC's Antibiotic Resistance Isolate Bank collection ((www)cdc.gov/ARIsolateBank/) that is intended as a test set for new diagnostic assays. Additionally, by targeting transcripts affected by antibiotics, which by definition affect core bacterial processes required for bacterial survival and whose transcriptional regulation is thus generally conserved (Wadsworth et al.), GoPhAST-R measures responses that are also likely to be conserved and therefore generalizable. Indeed, the fact that GoPhAST-R performed well on test strains that were selected randomly relative to training strains, that the sets of genes selected through iterative phase 1 and 2 training were relatively similar, and that the same classes of antibiotic elicit responses in similar pathways (Table 8) and even homologous genes (Table 9) across different species, all point to the ability of GoPhAST-R to account for the genetic diversity within a species. In addition to accommodating the potential variable transcriptional responses of strains within a species, by focusing on the most conserved regions of core transcripts by imposing a homology screen in the probe design process, GoPhAST-R also takes into account variability in genetic sequence of conserved genes in different strains. The initial sample set described herein attempted to capture significant diversity; yet larger numbers of strains will likely improve the current techniques further. By employing a classification process built on machine-learning algorithms that can be iteratively refined as more strains are tested, GoPhAST-R is able to incorporate new diversity to asymptotically improve performance. With wider testing, while the specific classifiers will improve, the general strategy and approach remains valid. Indeed, the capacity to learn through iterative retraining is one of the strengths of this approach as it is used more broadly. Likewise, extending this assay to more pathogen and antibiotic pairs will be advantageous for widespread clinical utility.

To extend GoPhAST-R in this manner, the entire pathway described herein for signature derivation, from RNA-Seq to iterative phases of NanoString® refinement and validation, are employed and advanced towards implementation in a clinical setting. Some antibiotics elicit responses in predictable pathways, exemplified by fluoroquinolones up-regulating SOS-response transcripts; however, it is expected that applying the instant diagnostic assay to certain new pathogen-antibiotic pairs will be performed with additional rigor to meet clinical performance mandates. For instance, when the instant approach was applied herein to *S. aureus* and *P. aeruginosa* treated with fluoroquinolones, it was identified that experimental derivation resulted in refined transcriptional signatures and control genes that were not predictable from prior assays on related pathogen-antibiotic pairs, often involving hypothetical or uncharacterized ORFs. This observed difficulty in predicting the best-performing responsive and control genes by inference from other species highlights the significance, at least ideally, of individualizing the expression signature for each pathogen-antibiotic pair, a process that is equivalent to the individualization currently employed by CLSI to extend traditional AST assays to new pathogen-antibiotic pairs. Fortunately, the experimental and computational approaches described herein allow for very rapid and conceptually straightforward extension to all pathogen-antibiotic combinations, and it is further noted that advances in RNA-Seq library construction and sequencing, described herein and elsewhere (Shishkin et al.), make a full derivation cycle for GoPhAST-R routine. Underscoring the ready generalizability of this approach, preliminary RNA-Seq data have been generated for 50 additional pathogen-antibiotic pairs, spanning Gram positive, Gram negative, and mycobacteria, that demonstrate early differential transcriptional responses to antibiotics in all cases tested (data not shown). While GoPhAST-R cannot completely overcome the challenge of identifying delayed inducible resistance (though this would be true for any rapid phenotypic test), it is noted that GoPhAST-R is expected to accurately identify at least some of these cases through simultaneous genotypic detection of induced resistance determinants, where known.

Following the approach described herein as a blueprint, it is contemplated that GoPhAST-R can be extended to all other pathogens and antibiotic classes, including those with novel mechanisms of action and as-yet-unknown or newly emerging mechanisms of resistance. Because GoPhAST-R is specifically informed by MIC, it leverages decades of prior studies linking in vitro behavior to clinical outcomes (CLSI), thereby facilitating its extension to new pathogens or antibiotics. It is further contemplated that the instant approach can be expanded to other clinical specimen types, beyond the instant demonstration performed upon cultured blood. Notably, while the application of a next-generation nucleic acid detection platform that can yield an answer in <4 hours has been described herein, a reliable transcriptional signature of susceptibility has actually been described as present in ≤1 hour for each of these key antibiotic classes. Thus, as RNA detection methods become faster and more sensitive, the GoPhAST-R approach is contemplated to offer even more rapid phenotypic AST on timescales that can inform early antibiotic decisions and thus transform infectious disease practice.

Example 9: Materials and Methods

Strain Acquisition and Characterization

All strains in this study (Table 7) were obtained from clinical or reference microbiological laboratories, including both local hospitals and MDRO strain collections from the Centers for Disease Control's Antibiotic Resistance Isolate Bank (see e.g., World Wide Web at (www).cdc.gov/ARIsolateBank/) and the New York State Department of Health. MICs reported from those laboratories were validated by standard broth microdilution assays (Wiegand, Hilpert, and Hancock 2008) in Mueller-Hinton broth; any discrepancies of >1 doubling from reported values were resolved by repeating in triplicate.

Rna-Seq Experimental Conditions

For each bacteria-antibiotic pair, selected clinical isolates (Table 7), two susceptible and two resistant, were grown at 37° C. in Mueller-Hinton broth to early logarithmic phase, then treated with the relevant antibiotic at breakpoint concentrations set by the Clinical Laboratory Standards Institute (CLSI): 2 mg/L for meropenem, 1 mg/L for ciprofloxacin, and 4 mg/L for gentamicin. Total RNA was harvested from paired treated and untreated samples at 0, 10, 30, and 60 minutes. cDNA libraries were made using a variant of the previously described RNAtag-Seq protocol (Shishkin et al. 2015) and sequenced on either an Illumina™ HiSeq or NextSeq. Sequencing reads were aligned using BWA (Li and Durbin 2009) and tabulated as previously described (Shishkin et al. 2015).

Differential Gene Expression Analysis and Selection of Responsive and Control Transcripts Differentially expressed genes were determined using the DESeq2 package (Love, Huber, and Anders 2014), comparing treated vs untreated samples at each timepoint. Fisher's combined probability test was used to select only those genes whose expression after antibiotic treatment was statistically distinguishable from its expression at any timepoint in the untreated samples. Gene ontology (GO) terms were assigned using blast2GO (version 1.4.4), with hypergeometric testing for enrichment. For each pathogen-antibiotic pair, the fold-change threshold in DESeq2 used to test statistical significance was increased to select 60-100 antibiotic-responsive transcripts with maximal stringency, a number readily accommodated by the NanoString® assay format. Control transcripts were also determined with DESeq2 using an inverted hypothesis test as described (Love, Huber, and Anders 2014) to select genes whose expression was expected to be unaffected by antibiotic exposure or growth in both susceptible and resistant isolates, at all timepoints and treatment conditions. As with responsive genes, the fold-change threshold was varied in order to select the top 10-20 control transcripts. The resulting control and responsive gene lists for each pathogen-antibiotic pair, and the fold-change thresholds used to generate them, are shown in Table 9. See Supplemental Methods sections below for further details.

Targeted Transcriptional Response to Antibiotic Exposure

After using BLASTn to identify regions of targeted transcripts with maximal conservation across all RefSeq genomes from that species (see Supplemental Methods), NanoString® probes were designed per manufacturer's standard process (Geiss et al. 2008) to these conserved regions. Strains treated with antibiotic at the CLSI breakpoint concentration, and untreated controls, were lysed via bead-beating at the desired timepoint. The resulting crude lysates were used as input for standard NanoString® (Seattle, WA) assays, which were performed on the nCounter® Sprint platform with variations on the manufacturer's protocol to enhance speed, detailed in Supplemental Methods. Raw counts for each target were extracted and processed as described in Supplemental Methods. Briefly, for each sample, each responsive gene was normalized by control gene expression as a proxy for cell loading using a variation on the geNorm algorithm (Vandesompele et al.), then converted to fold-induction in treated compared with untreated strains. Pilot NanoString® Hyb & Seq™ assays (FIGS. 12A and 12B) were performed on a prototype Hyb&Seq instrument at NanoString®, with 20 minute hybridization time and 5 imaging cycles to detect hybridization probes with two-segment 10-plex barcodes. See Supplemental Methods for more details.

Machine Learning: Feature Selection and Susceptibility Classification

For each pathogen-antibiotic pair, the normalized data were first partitioned, grouping half the strains into a derivation cohort on which the algorithm was trained, reserving the other half for validation (FIGS. 14A-14F), ensuring equivalent representation of susceptible and resistant isolates in each cohort.

In phase 1, implemented for all pathogen-antibiotic pairs, normalized fold-induction data of responsive genes from strains in the training cohort, along with CLSI susceptibility classification for each training strain, were input to the ReliefF algorithm using the CORElearn package (version 1.52.0) to rank the top 10 responsive transcripts that best distinguished susceptible from resistant strains. These 10 features were then used to train a random forest classifier using the caret package (version 6.0-78) in R (version 3.3.3) on the same training strains. Performance of this classifier was then assessed on the testing cohort, to which the classifier had yet to be exposed.

In phase 2, implemented for *K. pneumoniae*+meropenem and ciprofloxacin, all 18-24 strains from phase 1 were combined into a single, larger training set. For each antibiotic, ReliefF was again used to select the 10 most informative responsive transcripts, which were then used to train a random forest classifier on the same larger training set. Transcriptional data were then collected on a test set of 25-30 new strains using a trimmed NanoString® nCounter®

Elements™ probeset containing only probes for these 10 selected transcripts, plus 8-13 control probes. Susceptibility of each strain in this test set was predicted using the trained classifier. See Supplemental Methods for further detail on machine learning strategy and implementation.

For classification of simulated blood cultures, NanoString® data were collected for the top 10 transcripts (selected in phase 1) from 12 strains for each pathogen-antibiotic pair, and analyzed using a leave-one-out cross-validation approach (Efron & Gong), training on 11 strains and classifying the 12$^{th}$, then repeating with each strain omitted once from training and used for prediction.

Blood Culture Processing

Bacteria were isolated from real or simulated blood cultures in a clinical microbiology laboratory, isolated by differential centrifugation, resuspended in Mueller-Hinton broth, and immediately split for treatment with the indicated antibiotics. Lysis and targeted RNA detection were performed as above. Specimens were blinded until all data acquisition and analysis was complete. See Supplemental Methods for more detail. Samples were collected under waiver of patient consent due to experimental focus only on the bacterial isolates, not the patients from which they were derived.

Data Availability

All RNA-Seq data generated and analyzed during this study, supporting the analyses in FIGS. 2A-2D, have been deposited as aligned bam files in the NCBI Sequencing Read Archive under study ID PRJNA518730. All other datasets obtained herein, including raw and processed NanoString® data, are available upon reasonable request.

Code Availability

Custom scripts for transcript selection from RNA-Seq data are available at the World Wide Web at (www)github.com/broadinstitute/gene_select_v3/. Custom scripts for feature selection and strain classification from NanoString® data are available at World Wide Web at (www)github.com/broadinstitute/DecisionAnalysis/.

Example 10: Supplemental Methods

Rna Extraction for RNA-Seq:

After antibiotic treatment as described in the above Materials and Methods section, cells were pelleted, resuspended in 0.5 mL Trizol reagent (ThermoFisher Scientific), transferred to 1.5 mL screw-cap tubes containing 0.25 mL of 0.1 mm diameter Zirconia/Silica beads (BioSpec Products), and lysed mechanically via bead-beating for 3-5 one-minute cycles on a Minibeadbeater-16 (BioSpec) or one 90-second cycle at 10 m/sec on a FastPrep (MP Bio). After addition of 0.1 mL chloroform, each sample tube was mixed thoroughly by inversion, incubated for 3 minutes at room temperature, and centrifuged at 12,000×g for 15 minutes at 4° C. The aqueous phase was mixed with an equal volume of 100% ethanol, transferred to a Direct-zol spin plate (Zymo Research), and RNA was extracted according the Direct-zol protocol (Zymo Research).

Library Construction and RNA-Seq Data Generation:

Illumina cDNA libraries were generated using a modified version of the RNAtag-Seq protocol (Shishkin et al. 2015), RNAtag-Seq-TS, developed during the course of work for the instant disclosure, in which adapters are added to the 3' end of cDNAs by template switching (Zhu et al. 2001) rather than by an overnight ligation, markedly decreasing the time, cost, and minimum input of library construction. Briefly, 250-500 ng of total RNA was fragmented, DNase treated to remove genomic DNA, dephosphorylated, and ligated to DNA adapters carrying 5'-AN8-3' barcodes of known sequence with a 5' phosphate and a 3' blocking group. Barcoded RNAs were pooled and depleted of rRNA using the RiboZero RNA depletion kit (Epicentre). Pools of barcoded RNAs were converted to Illumina cDNA libraries in 2 main steps: with template switching, then library amplification. RNA was reverse transcribed using a primer designed to the constant region of the barcoded adaptor with addition of an adapter to the 3' end of the cDNA by template switching using SMARTScribe (Clontech). Briefly, two primers were added to the reverse transcription reaction to facilitate template switching: primer AR2 (Shishkin et al. 2015), which primes SMARTScribe reverse transcriptase off of the ligated adapter, and primer 3Tr3 (Shishkin et al. 2015), which contains 3 protected G's at the 3' terminus to complement the C's added to the 3' end of newly synthesized cDNA by SMARTScribe and also contains a 5' blocking group to prevent multiple template-switching events. These primers were pre-incubated with rRNA-depleted, adapter-ligated RNA (at 8.33 uM of each primer) at 72° C.×3 min, then 42° C.×2 min, then added directly to a master mix containing SMARTScribe buffer (1×), DTT (2.5 mM), dNTPs (1 mM each; NEB), SUPERase-In RNase inhibitor (1 unit; Invitrogen), and SMARTScribe reverse transcriptase enzyme (final primer concentration in reaction mixture: 5 uM each). This reaction mixture was incubated at 42° C.×60 min, then 70° C.×10 min, followed by addition of Exonuclease I (1 µL) and incubation at 37° C.×30 min. After 1.5×SPRI cleanup, the resulting cDNA library was PCR amplified using primers whose 5' ends target the constant regions of the ligated adapter (3' end of original RNA) and the template-switching oligo (5' end of original RNA) and whose termini contain the full Illumina P5 or P7 sequences. cDNA libraries were sequenced on the Illumina NextSeq 2500 or HiSeq 2000 platform to generate paired end reads.

Rna-Seq Data Alignment:

Sequencing reads from each sample in a pool were demultiplexed based on their associated barcode sequence. Barcode sequences were removed from the first read, as were terminal G's from the second read that may have been added by SMARTScribe during template switching. The resulting reads were aligned to reference sequences using BWA (Li and Durbin 2009), and read counts were assigned to genes and other genomic features as described (Shishkin et al. 2015). For each pathogen-antibiotic pair, a single reference genome was chosen for analysis of all four clinical isolates. This reference genome was selected by aligning a subset of RNA-Seq reads from each of the four isolates to all RefSeq genomes from that species and identifying the genome to which the highest percentage of reads aligned on average across all isolates. Since none of the isolates used for RNA-Seq have reference-quality genome assemblies themselves, and since four different isolates were used, not all genes in each isolate will be represented in the alignment. Yet for this application, any reads omitted due to the absence of a homologue in the reference genome used for alignment (i.e., accessory genes not shared by the reference) were assumed to be unlikely to be generalizable enough for diagnostic use. Using these criteria, the following reference genomes were chosen for alignment of RNA-Seq data for each of the following pathogen-antibiotic pairs: *K. pneumoniae*=NC_016845 for meropenem and ciprofloxacin, and NC_012731 for gentamicin; *E. coli*=NC_020163 for meropenem, and NC_008563 for ciprofloxacin and gentamicin; *A. baumannii*=NC_021726 for meropenem, and NC_017847 for ciprofloxacin and gentamicin. Note that for display purposes in FIGS. 5, 6, 10, 12A, 12B and 14A-14F, all responsive genes were named according to their homologues in the best-annotated reference available (NC_016845 for *K. pneumoniae*, NC_000913 for *E. coli*, and NC_017847 for *A. baumannii*) in order to convey gene names that were as meaningful as possible, instead of simply gene identifiers. Read tables were generated, quality control metrics examined, and coverage plots from raw sequencing reads in the context of genome sequences and gene annotations were visualized using GenomeView (Abeel et al. 2012). Aligned bam files were deposited to the Sequence Read Archive (SRA) under study ID PRJNA518730.

Selecting Candidate Responsive Genes from RNA-Seq Data:

The DESeq2 package (Love, Huber, and Anders 2014) was used to identify differentially expressed genes in treated vs untreated samples at each timepoint, in both susceptible and resistant strains. Analyses from select timepoints are displayed as MA plots in FIGS. 2A-2D. Since no statistically significant changes in transcription were observed in resistant strains, responsive gene selection was only carried out on susceptible isolates.

It was expected that the resulting list of differentially expressed genes would represent both genes that respond primarily to antibiotic exposure, and genes that respond to ongoing growth that may be prevented by antibiotic treatment in susceptible strains, i.e. whose differential expression upon antibiotic exposure is more a secondary effect. As an example of this type secondary effect, consider a gene whose expression is repressed by increasing cell density, or nutrient depletion from the medium, as cells grow. In the presence of antibiotic, cells may never reach that cell density; therefore, this gene would exhibit higher expression in the antibiotic-treated culture (where it is not repressed) than in the untreated culture (where it is repressed). Without any correction, this gene would appear indistinguishable from one whose expression is induced by antibiotic, although this may be entirely a secondary effect. Such "secondarily" regulated genes were reasoned to be more dependent upon precise growth conditions (media type, temperature, cell density, cell state, etc.—in other words, transcripts upregulated by progression towards stationary phase in minimal media will likely look different than that in rich media, etc.), some of which may vary across clinical samples. By contrast, since antibiotics target core cellular processes, it was hypothesized that the "direct" transcriptional response to antibiotic exposure would be more likely to be conserved across strains, which is critical for their success in a diagnostic assay. Therefore, a focus was placed on transcripts whose expression appeared to be a direct result of antibiotic exposure, rather than this indirect result of the effects of an antibiotic on the progression of the strain to different culture densities.

To identify such genes, additional differential expression analyses were carried out using DESeq2 to identify genes whose expression varied in untreated samples over the timecourse of the experiment. Such genes were very common: >10% of the transcriptome was differentially regulated at some timepoints compared with others in the timecourses of *K. pneumoniae* and *E. coli* (though considerably fewer in *A. baumannii* cultures). Therefore, the additional requirement that any candidate responsive gene exhibit a greater degree of differential expression in time-matched antibiotic-treated vs untreated samples at ≥1 timepoint, than it did in any untreated timepoint—in other words, that antibiotics induce a degree of induction or repression that exceeds that which was achieved at any timepoint in the absence of antibiotics—was imposed. To implement this, Fisher's combined probability test was imposed to combine p-values from each pairwise comparison, selecting those genes whose differential expression upon antibiotic treatment at a given timepoint exceeds their differential expression between any pair of points in the untreated timecourse, with adjusted p-value <0.05. As an additional filter for gene selection, in order to be sure to target genes with sufficient abundance to be readily detected in the hybridization assay, only genes in the upper 50% of expression in each condition were considered.

For most pathogen-antibiotic pairs, this analysis resulted in the identification of hundreds of candidate antibiotic-responsive genes. This process (differential expression analysis+Fisher's method) was repeated using progressively higher thresholds for the fold-change threshold used in the statistical test for differential expression, by increasing the lfcThreshold parameter in DESeq2 (for all comparisons, i.e. antibiotic treatment and each pair of untreated timepoints used in Fisher's method) until the resulting list of candidate responsive genes was 60-100 long, the size that was intended to target in phase 1 NanoString® assays. Table 9 shows the fold-change thresholds used to generate the final candidate responsive transcript list for each pathogen-antibiotic pair. This process was executed using custom scripts, available at World Wide Web at (www)github.com/broadinstitute/gene_select_v3/.

Selecting Candidate Control Genes from RNA-Seq Data

To quantitatively compare the transcription of key antibiotic-responsive genes, it is important to normalize for cell loading, lysis efficiency, and other experimental factors that may systematically affect absolute transcript abundance from a given sample. Such invariant transcripts (often referred to as "housekeeping" transcripts in qPCR) are important for scaling candidate responsive genes for comparison across samples, e.g. for comparing treated vs untreated samples. Control transcripts were therefore included in the NanoString® assay in order to normalize for these factors. Candidate control genes were identified by seeking transcripts whose expression did not change in the RNA-Seq timecourses, either upon antibiotic treatment or with over the untreated timecourse. To find such genes, a statistical test was imposed to find transcripts whose expression did not change by more than a certain fold-change threshold in any of the treated or untreated samples by re-running DESeq2 using an inverted hypothesis test (altHypothesis="lessAbs"), tuning the lfcThreshold parameter until the 10-20 best control genes were identified. Table 9 shows the fold-change thresholds used to generate the final candidate control transcript list for each pathogen-antibiotic pair.

Gene Ontology (GO) Term Enrichment:

For GO enrichment analysis, the same protocol was followed for responsive gene selection using DESeq2 and Fisher's method (see "Selecting candidate responsive genes from RNA-Seq data", above), with two exceptions. First, the lfcThreshold parameter (log2 fold change threshold) was set to 0, in order to capture all differentially expressed genes. Second, genes of any expression level were considered, since sensitivity of detection was not a concern. This process produced a list of all genes that were differentially expressed upon antibiotic exposure to a greater extent than at any timepoint in the absence of antibiotic, over the full timecourse tested (0, 10, 30, and 60 min). These differentially expressed genes were named according to the reference genome that best matched the four strains used for RNA-Seq, as described (see "RNA-Seq analysis", above). GO terms were assigned to annotated genes from each reference genome by blasting the peptide sequences for each ORF from that reference genome against a local database of ~120 well-annotated reference strains from NCBI using blast2GO (version 1.4.4; Gotz et al. 2008). GO terms associated with the list of differentially expressed genes was then compared with all GO terms associated with the genome, and hypergeometric testing was deployed to identify GO terms that were enriched to a statistically significant extent among the differentially expressed genes, using the Benjamini-Hochberg correction for multiple hypothesis testing. A false discovery rate threshold of 0.05 was used to generate the list of enriched GO terms in Table 8.

Homology Masking of Selected Responsive and Control Transcripts

Within each candidate responsive or control gene, regions of highest homology to target with NanoString® probes were identified. For each species, all complete reference genomes from RefSeq as of Jan. 1, 2016 were compiled, and BLASTn was run to identify the closest homologue of each desired target from each reference genome, and eliminated targets without an annotated homologue in at least 80% of genomes. A multi-sequence alignment was then constructed and queried each sliding 100mer window to keep only those windows with at least one 100mer region of >97% nucleotide identity across all reference genomes; all sequences failing to meet this homology threshold were "masked", i.e., removed from consideration as targets for probe design. If no such region was found, the homology threshold was relaxed to >95% identity, then to >92% identity; if no region with at least 92% identity was found, the transcript was deemed too variable to reliably target and thus eliminated from consideration entirely. The window size of 100 nucleotides was chosen because NanoString® detection involves targeting with two ~50mer probes that bind consecutive regions (Geiss et al. 2008). The resulting homology-masked sequences, retaining only those regions of intended target transcripts with sufficient homology, were then provided to NanoString® for their standard probe design algorithms (Geiss et al. 2008).

Design of NanoString® Probes for Carbapenemase and Extended-Spectrum Betalactamase Gene Families:

All gene sequences representing each targeted antibiotic resistance gene family (carbapenemases: KPC, NDM, OXA-48, IMP, VIM; ESBLs: CTX-M-15, OXA-10) were collected from representatives reported in three databases of antibiotic resistance genes: Resfinder (Zankari et al. 2012), ArDB (Liu and Pop 2009), and the Lahey Clinic catalog of beta-lactamases on the World Wide Web at (www)lahey.org/Studies. Additional representatives of each family were identified by homology search (BLASTp, E-value <10-10, >80% similarity) against the conceptual translation of genes identified in the genomes of isolates collected as part a multi-institute analysis of carbapenem-resistant Enterobacteriaceae specimens (Cerqueira et al. 2017). All other genes in the pan-genome of that cohort that did not meet the homology search criterion for inclusion as one of the targeted families were consolidated in an outgroup sequence database, which was used to screen for cross-reactivity. This outgroup contains many other non-targeted beta-lactamases, as well as the complete genomes of hundreds of Enterobacteriaceae isolates (Cerqueira et al. 2017). For each targeted antibiotic resistance gene family, target regions for NanoString® probe design were identified as described above (see above section entitled Homology masking of selected responsive and control transcripts) by identifying regions with >95% sequence homology across 150 nucleotides in >90% of homologues within that family. In order to minimize risk of cross-reactivity with undesired targets, these conserved regions of the desired targets were then compared by BLASTn to the outgroup database, and any regions with E-value <10 were discarded. For the IMP gene family, no region of sufficient conservation could be identified due to sequence diversity within the family, consistent with reports that it is difficult to uniformly target by PCR (Kaase et al. 2012). Four different regions were identified that together were predicted to cover all IMP homologs from these databases, i.e., where each IMP homolog contained a stretch of sufficient homology to one or more of the four regions. These regions were submitted to NanoString® for probe design by their standard algorithms (Geiss et al. 2008), including four separate probe pairs for IMP (Table 9). Signal from each of these four IMP probes was combined to yield a single combined total IMP signal (see section entitled "NanoString® data processing, normalization, and visualization" below).

Lysate Preparation for NanoString® Transcriptional Profiling Assays:

Each strain to be tested was grown at 37° C. in Mueller-Hinton broth to mid-logarithmic phase, and split into a treated sample, to which antibiotic was added at the CLSI breakpoint concentration, and an untreated control. Both samples were grown for the specified time (30-60 min), then a 100 μL aliquot of culture was added to 100 μL of RLT buffer (Qiagen) plus 1% beta-mercaptoethanol and mechanically lysed using either the MiniBeadBeater-16 (BioSpec) or the FastPrep (MP Biomedicals). This crude lysate was either used directly for hybridization, or frozen immediately and stored at −80° C., then thawed on ice prior to use.

Nanostring® nCounter® Assays:

All Phase 1 and Phase 2 NanoString® experiments (see FIG. 5) were performed on a NanoString® nCounter® Sprint instrument, with hybridization conditions as per manufacturer's recommendations, including a 10% final volume of crude lysate as input. Phase 1 experiments used probesets made with XT barcoded probe pools and were hybridized for 2 hours at 65° C., while Phase 2 experiments used probesets made with nCounter® Elements™ probe pools plus cognate barcoded TagSets (ref?) and were hybridized for 1 hour at 67° C., rather than the 16-24 hour hybridizations as recommended by the manufacturer's protocol. Including 30-60 min for antibiotic exposure and these hybridizations, plus a 6 hour run for 12 samples, the total run time was under 8 hours for phase 2. Technical replicates for five strains run on separate days resulted in Pearson correlations of 0.95-0.99 for normalized data, consistent with expectations for this assay platform (Geiss et al. 2008), indicating that the shorter hybridization time did not affect reproducibility.

Phylogenetic Analysis of Strains Included in this Study:

The Genome Tree report was downloaded for each species from the National Center for Biotechnology Information (NCBI; ncbi.nlm.nih.gov) in Newick file format and uploaded to the Interactive Tree of Life (iTOL; itol.embl.de; Letunic et al. 2019) for visualization and annotation. Strains from the instant disclosure that were available on NCBI were identified using strain name or other identifying metadata from the NCBI Tree View file, cross-referencing the NCBI ftp server (ftp.ncbi.nlm.nih.gov/pathogen/Results/) as needed to confirm strain identity.

Rapid Transcriptional Profiling with Pilot NanoString® Hyb & Seq™ Assay Platform For the rapid pilot GoPhAST-R experiment on a prototype Hyb & Seq™ instrument at NanoString® (FIGS. 12A and 12B), pairs of capture probes (Probe A and Probe B) were constructed for all targets of interest such that each pair could uniquely bind to one target transcript. For Hyb & Seq™ chemistry (FIG. 12A), each Probe A contained a unique target binding region, a universal purification sequence, and an affinity tag for surface immobilization. Each Probe B contained another unique target binding region, a barcoded sequence for downstream signal detection, and a common purification sequence that was different from that of Probes A. For multiplexed RNA profiling, crude lysates were mixed with all capture and reporter probes in a single hybridization reaction and incubated on a thermocycler with heated lid at 65° C. for 20 min. This hybridization reaction enables formation of unique trimeric complexes between target mRNA, Probe A, and Probe B for each target.

Three sequential steps of post-hybridization purification were then performed to ensure minimal background signal. Briefly, the hybridization product was first purified over magnetic beads coupled to oligonucleotides complementary to the universal sequence contained on every Probe B. The hybridization product was first incubated with the beads in 5×SSPE/60% formamide/0.1% Tween20 at room temperature for 10 min in order to bind all target complexes containing Probes B, along with the free (un-hybridized) Probes B, onto the beads. Bead complexes were then washed with 0.1×SSPE/0.1% Tween20 to remove unbound oligos and complexes without Probes B. The washed beads were then incubated in 0.1×SSPE/0.1% Tween20 at 45° C. for 10 min to elute the bound hybridized complexes off the beads. This second purification was carried out per manufacturer's instructions using Agencourt AMPure XP beads (Beckman Coulter) at a 1.8:1 volume ratio of beads to sample, in order to remove oligos shorter than 100 nt. This size-selective purification recovers the bigger hybridization complexes while removing smaller free capture Probes A and B. Eluates from these AMPure beads were purified over a third kind of magnetic beads coupled to oligonucleotides complementary to the common purification sequence contained on every Probe A, similar to the first bead purification, then eluted at 45° C. These triple-purified samples were driven through a microfluidic flow cell on a readout cartridge by hydrostatic pressure within 20 min. The flow cell was enclosed by a streptavidin-coated glass slide that can specifically bind to the affinity tag (biotin) of each Probe B, allowing the immobilization of purified complexes on the glass surface.

The cartridge with samples loaded was mounted on a Hyb & Seq™ prototype instrument equipped with an LED light source, an automated stage, and a fluorescent microscope. The barcoded region of each Probe A consisted of two short nucleic acid segments, each of which can bind to one of ten available fluorescent bi-colored DNA reporter complexes as dictated by complementarity to the exact segment sequences. To detect each complex captured on the glass surface (FIG. 12B), photocleavable fluorescent color-coded reporters were grouped by their target segment location and introduced into the flow cell one pool at a time. Following each reporter pool introduction, the flow cell was washed with non-fluorescent imaging buffer to remove unbound reporter complexes and scanned by the automated Hyb & Seq prototype. Each field of view (FOV) was scanned at different excitation wavelengths (480, 545, 580 and 622 nm) to generate four images (one for each wavelength) and then exposed to UV (375 nm) briefly to remove the fluorophore on surface-bound reporter probes by breaking a photocleavable linker. The flow cell was then subjected to a second round of probing with a new reporter pool targeting the second segment location on each Probe A. Thus, two rounds of probing, washing, imaging and cleavage completed one Hyb & Seq barcode readout cycle (FIG. 12B). In order to improve signal-to-noise ratio, 5 such cycles were completed for each assay. Between each cycle, the flow cell was incubated with low salt buffer (0.0033×SSPE/0.1% Tween20) to remove all bound reporter complexes without disrupting the ternary complex between Probe A, target mRNA, and Probe B.

A custom algorithm was implemented to process the raw images for each FOV on a FOV-by-FOV basis. This algorithm can identify fluorescent spots and register images between each wavelengths and readout cycles. A valid feature is defined as a spot showing positive fluorescence readout for all barcoded segment locations in the same spatial position of each image after image registration. The molecular identity of each valid feature is determined by the permutation of color codes for individual rounds of barcode segment readout. In this implementation, the maximal degree of available multiplexing for a single assay using 10-plex reporter pools was $10^2$=100 kinds for two-segment barcodes, but up to four-segment barcodes are available, permitting up to $10^4$=10,000 distinct barcodes. This algorithm provides tabulated results for the total raw count of each reporter barcode of interest identified in a single assay. These raw counts are used as input for subsequent data processing, visualization, and further analysis.

Nanostring® Data Processing, Normalization, and Visualization:

For each sample, read counts from each targeted transcript were extracted using nSolver Analysis Software (v4.070, NanoString®, Seattle WA). Raw read counts underwent the following processing steps, all executed in R (version 3.3.3), utilizing the packages dplyr (version 0.7.4), xlsx (version 0.5.7), gplots (version 3.0.1), and DescTools (version 0.99.23):

1. Data aggregation: all data for a given pathogen-antibiotic pair, for a given phase of analysis (eg phase 1 or phase 2), was read in to a single data object so that all subsequent data processing steps were done together.
2. Positive control correction: per manufacturer's protocol, ERCC spike-ins were included in every hybridization at known concentrations, spanning the range of expected target RNA concentrations. For each sample, the geometric mean of counts from positive control probes targeting these ERCC spike-ins was calculated. This geometric mean was used to scale each remaining probe in the sample, in order to standardize across lanes for any systematic variation.
3. Negative control subtraction: per manufacturer's protocol, for each sample, the mean of negative control probes targeting ERCC spike-ins not present in the hybridization reaction were subtracted from the raw read counts for each target.
4. Failed probe removal: any control probe with fewer than 10 reads, or any responsive control with negative reads, after negative control subtraction in any sample was removed from all samples for a given pathogen-antibiotic pair, in order to omit transcripts whose content, sequence, or expression was too variable across strains.
5. Selection of optimal control probes: among the set of candidate control probes, across all strains in a given phase of analysis, the subset of these control probes that performed most consistently across samples was selected using a variation on the geNorm algorithm (Vandesompele et al. 2002). The principle behind this algorithm is that the per-cell expression of ideal control probes will not vary under any experimental conditions, and therefore, the ratio between expression levels of a set of ideal control probes will be constant (reflecting only the difference in cell number in each sample). Accordingly, the coefficient of variation of each control probe with the geometric mean of all control probes was calculated. In the ideal case, this coefficient of variation will be zero. The candidate control probe with the highest coefficient of variation is removed, and the process is repeated with the remaining control probes until the highest coefficient of variation is less than a threshold set to yield an acceptable number of non-operonic control transcripts, typically 4-8. For these experiments, this threshold was adjusted from 0.2 to 0.3 depending on the bacteria-antibiotic pair. Thresholds chosen, and the optimal control probes used at this threshold, are noted in Table 9.

6. Control transcript normalization: the geometric mean of the optimal control probes was calculated for each sample and used to normalize all remaining read counts from that sample, i.e. for candidate responsive transcripts, and for carbapenemase or ESBL genes (if applicable), by dividing these corrected read counts by this geometric mean for each sample.
7. Calculation of fold-induction of normalized responsive transcripts by antibiotic: for each candidate responsive transcript, normalized counts from each antibiotic-treated strain were divided by normalized counts from untreated samples of the same strain. These fold-inductions of normalized expression for each candidate responsive transcript were used as input into machine learning algorithms, both reliefF for feature selection and the caret package for random forest classification.
8. Log-transformation of fold-induction data for responsive transcripts: for visualization, the natural logarithm of fold-inductions of normalized expression for each candidate responsive transcript was calculated and displayed using the heatmap.2 function of the gplots R package (version 3.0.1). For each set of strains, ln(fold induction) for each transcript was clustered using the default hclust function, and strains were ordered by MIC.
9. Combination of IMP probes: because of the variability of gene sequences in the IMP family, four separate IMP probes were designed, one or more of which was expected to recognize all sequenced members of this gene family. Following control gene normalization, signal from the four separate probes was added together to give a single IMP score.
10. Background subtraction for carbapenemase/ESBL gene detection: For each species, the subset of tested strains was identified for which whole-genome-sequencing (WGS) data was available and none of the target beta-lactamase genes was found. From this subset, the arithmetic mean plus two standard deviations of the normalized signal from each probe (step 6) was calculated, and this mean+two standard deviations was subtracted from the normalized signal from each probe across all tested samples. All carbapenemases identified by WGS were detected above background, though the two *A. baumannii* isolates expressing blaNDM were only detected at very low levels. Background-subtracted data were log-transformed for visualization (any probe with a negative value after background-subtraction was set to 0.1 normalized counts for all standard nCounter experiments, or to 0.25 normalized counts for Hyb & Seq experiments, prior to log-transformation).

One-Dimensional Projection of Transcriptional Data Via Squared Projected Distance (SPD) Metric:

Normalized, log-transformed fold-induction data from the ~60-100 responsive were collapsed into a one-dimensional projection referred to as a squared projected distance (SPD), essentially as described (Barczak et al. 2012). Conceptually, the transcriptional response of a test strain is placed on a vector in N-dimensional transcriptional space (where N=number of responsive genes, here ~60-100 per probeset) between the average position (i.e. centroid in transcriptional space) of a derivation set of susceptible strains (defined as SPD=0) and the average position of a derivation set of resistant strains (defined as SPD=1). All vector math was performed exactly as described (Barczak et al. 2012) and implemented in R (version 3.3). For each pathogen-antibiotic pair, the same strains used for RNA-Seq were also used as the derivation set of two susceptible and two resistant strains, in order to ensure that the resulting projections of the remaining strains were not self-determined. In other words, only the strains used to select the transcripts to be used in the NanoString® experiments (based on RNA-Seq) were used to set the average position of susceptible or resistant isolates; any tendency of other isolates to cluster at a similar SPD as these derivation strains, either susceptible or resistant, is thus due to a similarity in their transcriptional profiles. These derivation strains are labeled in Table 7 as “deriv_S” and “deriv_R” for susceptible and resistant strains, respectively. SPD data are plotted by CLSI class (FIG. 4A) and by MIC (FIG. 4B), showing a proportional relationship between MIC and this summative metric of transcriptional response to antibiotic exposure upon treatment at the breakpoint concentration (vertical dashed line).

Approach to Strain Classification Based on NanoString® Data:

In order to select the most distinguishing features and to classify isolates as susceptible or resistant, machine learning algorithms were utilized and implemented in two phases (FIG. 5).

In phase 1, NanoString® XT probesets were designed targeting dozens (60-100) of antibiotic-responsive transcripts (Table 9) selected from RNA-Seq data as described and used to quantify target gene expression from 18-24 isolates of varying susceptibility, both treated and untreated with the antibiotic in question, from which normalized fold-induction data for each responsive gene candidate was determined as described above. These isolates are partitioned into 50% training strains and 50% testing strains, randomly but informed by MIC: isolates are sorted in order of MIC and then alternately assigned to training and testing sets in order to ensure a balanced mix of isolates in each cohort across the full range of MICs represented by the strains in question. The only exceptions to random strain assignments to training vs testing sets in Phase 1 were: (1) intermediate isolates were not used for training, but were assigned to the validation cohort (and were grouped with resistant isolates for accuracy reporting, i.e., “not susceptible”), and (2) the two *E. coli* isolates with large meropenem inoculum effects were noted prior to randomization and deliberately assigned to the validation cohort, given the physiological basis for their discrepant transcriptional response from that of a conventional susceptible strain. From the training (derivation) cohort, the top 10 features were first selected using reliefF (see details below, “Feature selection from NanoString® data”), then a random forest model was trained on this derivation cohort using the caret package, then implemented on the testing (validation) cohort, using only data from these top 10 selected features (see details below, "Random forest classification of strains from NanoString® data"). Accuracy of GoPhAST-R in this phase was assessed by comparing predictions of the random forest model for the strains in the testing cohort, which it had never previously seen, with known susceptibility data for these strains (FIG. 7A; Table 10).

In phase 2, the training and testing cohorts from phase 1 were first combined into a single, larger training set, and selection of the top 10 responsive features were repeated using the same algorithms (reliefF). These represent the best-informed prediction of the 10 responsive probes that most robustly discriminate between susceptible and resistant isolates, and are highlighted in Table 9 for each pathogen-antibiotic combination (column F=either "Phase 2" or "Top feature"). A new NanoString® nCounter® Elements™ probeset was then designed for each pathogen-antibiotic pair, targeting only these 10 transcripts as well as ~10 control probes that performed best in phase 1 (i.e. had the lowest coefficients of variation compared with the geometric mean of all control probes, using the variation on the geNorm algorithm described above; also indicated in Table 9, column F). For *K. pneumoniae*+meropenem and ciprofloxacin, an additional 25-30 strains were tested using these focused phase 2 probesets, again quantifying target gene expression and normalized fold-induction of these responsive genes with and without antibiotic exposure. These data were supplied to the random forest classifier trained on all data from phase 1, and the resulting classifications of phase 2 strains were compared with known susceptibility data for these strains (FIG. 7B; Table 10). Of note, phase 2 deploys GoPhAST-R in exactly the way it was envisioned being deployed on true unknown samples: each of the phase 2 strains was an unknown, considered independently and not used at any point to train the model, only to assess its performance one strain at a time.

Every strain tested was an independent clinical isolate, with two minor exceptions. First, in the case of *A. baumannii*+ciprofloxacin, there were not sufficient numbers of independent ciprofloxacin-susceptible *A. baumannii* isolates to train and test a classifier (only five out of 22 *A. baumannii* isolates). For this bacteria-antibiotic pair, biological replicates of the two susceptible strains used for RNA-Seq, RB197 (three replicates) and RB201 (two replicates) were run. These biological replicates were grown from separate colonies in separate cultures, each split into treated and untreated samples. All three RB197 replicates ended up randomized to the phase 1 training set, while both RB201 replicates were randomized to the phase 1 testing set. Since there was not training on one biological replicate and testing on another, the reported categorical agreement should not be confounded by excessive similarity between replicates. One additional linkage between isolates was that one *A. baumannii* isolate, RB197, exhibited two distinct colony morphotypes upon streaking onto LB plates: a dominant, larger morphotype, and a less abundant, smaller morphotype. The smaller morphotype was renamed RB197s and tested in both the meropenem and ciprofloxacin datasets, randomized to the testing (validation) cohort in both cases.

Feature Selection from NanoString® Data:

For feature selection in both phase 1 and phase 2, the reliefF algorithm (Robnik-Šikonja and Kononenko 2003) was employed using the CORElearn package (version 1.52.0) in R (version 3.3.3) to generate a list of features ranked in order of importance in distinguishing susceptible from resistant strains within the training set. The input to the reliefF algorithm was normalized fold-induction data from all responsive probes, and the CLSI classification, for each training isolate. (For this analysis, CLSI classification was simplified into two classes by grouping intermediate strains with resistant strains, in keeping with common clinical practice to avoid an antibiotic for which an isolate tests intermediate.)

The process by which reliefF generates its ranking has been well-described elsewhere (Robnik-Šikonja and Kononenko 2003). The specific estimator algorithm (lEst parameter) "ReliefFexpRank", which considers the k nearest hits and misses, was chosen with the weight of each hit and miss exponentially decreasing with decreasing rank. This was iterated five times (ltimes parameter=5), with a separate 80% partition of the training data for each iteration, then averaged feature weight across each of these five iterations to generate the final ranked list. The output from this reliefF algorithm is a ranked list of features that best distinguish susceptible from resistant isolates; from this list, and the top 10 features (featureCount parameter=10) were kept. The same parameter values were chosen for feature selection for both phase 1 (i.e., on the half of the phase 1 data assigned to the training set) and phase 2 (i.e., using all of the phase 1 data, for use in designing new probesets for de novo data acquisition in phase 2).

Random Forest Classification of Strains from NanoString® Data:

To build a random forest classifier, the caret (classification and regression training) package (version 6.0-78) in R (version 3.3.3) was employed to classify strains in the testing cohort. Input data for this algorithm are normalized fold-inductions of the top 10 responsive genes selected by reliefF for both training and testing strains, and CLSI classifications for each training strain (again with intermediate and resistant isolates grouped together). This random forest model is a common example of an ensemble classifier (Liaw et al. 2001) that embeds feature selection and weighting in building its models, which should mitigate risk for overtraining from including additional features from reliefF, since features not required for accurate classification need not be considered. It enacts 5-fold cross-validation on the training set, i.e. 80% sampling of the testing data, run 5 times, to optimize parameters including "mtry", "min.node.size", and "splitrule", to build 500 trees (parameter "ntree" set to 500) based on prediction of the omitted training strains. After these hyperparameters are optimized through this cross-validation, an additional 500 trees are built using all of the training data and used to classify strains from the test set, one strain at a time. The resulting output is this classifier model that generates predictions for the classification of each test strain, reported as "probability of resistance" (probR) based on what fraction of trees ended up classifying the strain as resistant. (For instance, a strain with probR of 0.2 was classified as susceptible in 100 trees and as resistant in 400.) For quantitative assessment of accuracy, the prediction of the most likely class as the ultimate classification (i.e., if probR >0.5, the classifier is predicting resistant; if probR <0.5, the classifier is predicting susceptible) was used. One might ultimately choose to set this threshold somewhere other than 0.5: since the cost of misclassifying a resistant isolate as susceptible (a "very major error" in the parlance of the FDA) is greater than the cost of misclassifying a susceptible isolate as resistant, one might wish to label an isolate resistant if its probR is, say, 0.3. However, for simplicity, and to avoid overtraining on the relatively limited number of samples in this manuscript, the default threshold of 0.5 was chosen, accepting the classifier's prediction as to which state is more likely.

Reproducibility of GoPhAST-R Classification:

Phase 2 probesets for meropenem susceptibility were combined with probes for carbapenemase and ESBL gene detection (Table 9). For *K. pneumoniae*+meropenem, in addition to testing all phase 2 strains simultaneously for phenotypic AST and genotypic resistance determinants, 23 of 24 phase 1 strains were retested using the phase 2 probeset in order to capture their carbapenemase and ESBL gene content. This provides a set of effective technical replicates for assessing the robustness of the classifier, since all phase 2 genes are included as a subset of the phase 1 probeset, but all data were regenerated in a new NanoString® experiment using the phase 2 probeset with added genotypic probes.

All 23 retested strains (11 susceptible, 12 resistant) were classified correctly based upon data from the phase 2 probeset; of these 23 strains, 12 (6 susceptible, 6 resistant) were phase 1 training strains (that were therefore not previously classified in phase 1), and 11 (5 susceptible, 6 resistant) were phase 1 testing strains that were classified the same way based upon data from the phase 2 probeset as they had been in phase 1 testing. The probability of resistance (probR) parameters for these 23 replicates from phase 1 (Table 10) versus those from "re-classification" using data from the phase 2 probeset were highly correlated (Pearson correlation coefficient=0.95). Note that because these same strains were used in training the random forest classifier, the results of re-classification of these retested strains are not included in the accuracy statistics reported elsewhere in this manuscript. The 100% concordance observed for re-classification of these 23 strains is thus not a reflection of GoPhAST-R's accuracy, but does speak to its reproducibility.

Blood Culture Processing:

Under Partners IRB 2015P002215, 1 mL aliquots from blood cultures in the MGH clinical microbiology laboratory whose Gram stain demonstrated gram-negative rods were removed for processing. For simulated blood cultures, consistent with clinical microbiology laboratory protocol (Clark et al. 2009), blood culture bottles were inoculated with individual isolates of each pathogen suspended in fetal bovine serum at <10 cfu/mL to simulate clinical samples and incubated in a BD BacTec FX instrument (BD Diagnostics; Sparks, MD) in the clinical microbiology laboratory at Massachusetts General Hospital, or on a rotating incubator at 37° C. in the research laboratory at the Broad Institute. Once the BacTec instrument signaled positive (after 8.5-11.75 hours of growth), or after an equivalent time to reach the same culture density in the research laboratory (confirmed by enumeration of colony-forming units), 1 mL aliquots were removed for processing. Bacteria were isolated by differential centrifugation: 100 xg×10 min to pellet RBCs, followed by 16,000 xg×5 min to pellet bacteria. The resulting pellet was resuspended in 100 μL of Mueller-Hinton broth and immediately split into 5×20 μL aliquots for treatment with the indicated antibiotics (three antibiotics, plus two untreated samples, one for harvesting at 30 min to pair with the ciprofloxacin-treated aliquot and one at 60 min to pair with both meropenem- and gentamicin-treated aliquots). After the appropriate treatment time, 80 μL of RLT buffer+1% beta-mercaptoethanol was added to 20 μL of treated bacterial sample, and lysis via bead-beating followed by NanoString® detection were carried out as above (see "Lysate preparation for NanoString® transcriptional profiling assays" section). For real blood cultures, lysates were stored at −80° C. until organisms were identified in the laboratory by conventional means; only samples containing *E. coli* or *K. pneumoniae* were run on NanoString®. GoPhAST-R results were compared with standard MIC testing in the MGH clinical microbiology laboratory, which were also run on simulated cultures. Specimens were blinded until all data acquisition and analysis was complete. For head-to-head time trial compared with gold standard AST testing in the MGH clinical microbiology laboratory (subculture+VITEK-2), blood culture processing steps were timed in the research laboratory (Boston, MA, USA), then frozen and shipped to NanoString® for transcript quantification on the prototype Hyb & Seq™ platform at NanoString® (Seattle, WA, USA). A timer was restarted when lysates were thawed, and the total time at each site was combined to estimate the complete assay duration.

Blood Culture AST Classification:

Simulated blood cultures were classified using the same random forest approach as cultured strains, using the top 10 features selected during Phase 1 for each pathogen-antibiotic pair. This was implemented using leave-one-out cross-validation (Efron et al. 1983) rather than an even partitioning into training and testing because (1) feature selection was already complete, allowing multiple rounds of classifier training without requiring one unified model, and (2) given this, leave-one-out cross-validation (i.e., iteratively omit each strain once from training, test on the omitted strain, repeat with each strain omitted) allowed for training on the maximum number of strains.

TABLE 7

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | KpMero | | | CRE | | | |
|---|---|---|---|---|---|---|---|---|---|
| STRAIN | Alt name 1 | Alt name 2 | Phase 1 | Phase 2 | mero MIC (mg/L) | Known gene(s) in probeset | Other known bla gene(s) | Source | Comments |
| AR0034 | CarbaNP-03 | | | x | 2 | IMP-4 | TEM-1B; SHV-11 | CDC | ARBank |
| AR0040 | CarbaNP-09 | RB408 | x | (x) | >32 | VIM-27; CTX-M-15 | SHV-11; OXA-1 | CDC | ARBank |
| AR0041 | CarbaNP-10 | RB826 | | x x | 16 | NDM-1; CTX-M-15; OXA-10 | CMY-4; SHV-11 | CDC | ARBank |
| AR0042 | CarbaNP-11 | RB410 | x | (x) | <0.5 | CTX-M15; OXA-10 | TEM-1B; SHV-1; OXA-1 | CDC | ARBank |
| AR0043 | CarbaNP-12 | RB411 | x | | 2 | | SHV-12 | CDC | ARBank |
| AR0044 | CarbaNP-13 | | | x | 4 | CTX-M-15 | OXA-9; TEM-1A; SHV-12; OXA-1 | CDC | ARBank |
| AR0047 | CarbaNP-16 | | | x | 4 | | TEM-1A | CDC | ARBank |
| AR0075 | CarbaNP-44 | RB414 | x | (x) | 8 | CTX-M15 | OXA-232; SHV-1; OXA-1 | CDC | ARBank |
| AR0087 | CarbaNP-56 | RB417 | x | (x) | 1 | | SHV-12 | CDC | ARBank |
| AR0135 | CRE-24 | | | x | 8 | VIM-1 | OXA-9; TEM-1A; SHV-12 | CDC | ARBank |
| AR0139 | CRE-28 | | | x x | 32 | NDM-1; CTX-M-15; OXA-10 | CMY-4; SHV-11 | CDC | ARBank |
| BAA2524 | RB554 | | | x | 0.5* | OXA-48 | | ATCC | |
| BIDMC_14 | RB289 | | | x | 16 | KPC-3 | SHV-134; | BIDMC<br>TEM-1 | Cerqueira et al, PNAS 2017 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | |
|---|---|---|---|---|---|---|---|---|
| BIDMC_21 | RB563 | | | | | | BIDMC | Cerqueira et al, PNAS 2017 |
| BIDMC_22 | RB564 | | x | 0.25 | | SHV-134 | BIDMC | Cerqueira et al, PNAS 2017 |
| BIDMC_31 | RB565 | | x | 0.125 | | SHV-38 | BIDMC | Cerqueira et al, PNAS 2017 |
| BIDMC_35 | RB552 | x | (x) | >32 | OXA-10 | SHV-134 | BIDMC | Cerqueira et al, PNAS 2017 |
| BIT-03 | RB400 | x | (x) | 8 | KPC (unknown type) | | CDC | precursor to ARBank strain collection, shared by J. Patel |
| BIT-04 | RB401 | x (deriv_R) | x (deriv_R) | 32 | KPC (unknown type) | | CDC | precursor to ARBank strain collection, shared by J. Patel |
| BIT-05 | RB402 | x | (x) | >32 | KPC (unknown type) | | CDC | precursor to ARBank strain collection, shared by J. Patel |
| BIT-12 | RB404 | x | (x) | <0.5 | | | CDC | precursor to ARBank strain collection, shared by J. Patel |
| BIT-16 | RB405 | x | (x) | ≤0.5 | | | CDC | precursor to ARBank strain collection, shared by J. Patel |
| BWH_15 | RB268 | x | (x) | 8 | KPC-4 | SHV-134; TEM-1 | BWH | Cerqueira et al, PNAS 2017 |
| BWH_2 | RB551 | | x | 16 | CTX-M-15; OXA-48 | OXA-30; OXA-9; SHV-38; TEM-1 | BWH | Cerqueira et al, PNAS 2017 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | |
|---|---|---|---|---|---|---|---|---|
| BWH_30 | RB270 | x | (x) | ≤0.5 | | SHV-134 | BWH | Cerqueira et al, PNAS 2017 |
| BWH_36 | RB271 | x | (x) | 16 | KPC-3 | SHV-134; TEM-1 | BWH | Cerqueira et al, PNAS 2017 |
| CDC_1500610 | RB419 | x | (x) | ≤0.5 | | | CDC | precursor to ARBank strain collection, shared by J. Patel |
| IDR1200023303 | RB596 | x | (x) | >32 | | SHV-38 | NYDOH | shared by K. Musser |
| IDR1600031102-01-00 | RB579 | x | (x) | >32 | NDM-1; CTX-M15 | | NYDOH | shared by K. Musser |
| IDR1600037310 | RB587 | x | (x) | 1 | CTX-M-15 | | NYDOH | shared by K. Musser |
| IDR1600057468-01-00 | RB584 | | x | 4 | CTX-M-15 | | NYDOH | shared by K. Musser |
| MGH_17 | RB273 | | x | ≤0.5 | | SHV-134 | MGH | Cerqueira et al, PNAS 2017 |
| MGH_18 | RB274 | x (deriv_S) | x (deriv_S) | ≤0.5 | | SHV-134 | MGH | Cerqueira et al, PNAS 2017 |
| MGH_19 | RB275 | x | (x) | ≤0.5 | | SHV-134 | MGH | Cerqueira et al, PNAS 2017 |
| MGH_20 | RB276 | | x | ≤0.5 | | SHV-134 | MGH | Cerqueira et al, PNAS 2017 |
| MGH_31 | RB291 | | x | 8 | | SHV-134 | MGH | Cerqueira et al, PNAS 2017 |
| MGH_35 | RB543 | | x | 2 | CTX-M-15 | OXA-30; SHV-134; TEM-1 | MGH | Cerqueira et al, PNAS 2017 |
| MGH_36 | RB280 | | x | ≤0.5 | | SHV-38 | MGH | Cerqueira et al, PNAS 2017 |
| MGH_39 | RB780 | | x | 2 | KPC-3 | OXA-9; SHV-38; TEM-1 | MGH | Cerqueira et al, PNAS 2017 |
| MGH_48 | RB284 | | x | ≤0.5 | | SHV-134 | MGH | Cerqueira et al, PNAS 2017 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | |
|---|---|---|---|---|---|---|---|---|
| MGH_71 | RB462 | | x | 32 | KPC-2; OXA-10 | SHV-134; TEM-1 | MGH | Cerqueira et al, PNAS 2017 |
| RB039 | | x (deriv_S) | x (deriv_S) | ≤0.5 | | | BWH | this paper |
| RB041 | | | x | ≤0.5 | | | BWH | this paper |
| RB042 | | | x | ≤0.5 | | | BWH | this paper |
| UCI_19 | RB285 | x (deriv_R) | x (deriv_R) | >32 | KPC-2 | SHV-134; TEM-1 | UCI | Cerqueira et al, PNAS 2017 |
| UCI_37 | RB290 | x | (x) | 32 | KPC-3 | OXA-9; SHV-38; TEM-1 | UCI | Cerqueira et al, PNAS 2017 |
| UCI_38 | RB288 | x | (x) | ≤0.5 | | SHV-134 | UCI | Cerqueira et al, PNAS 2017 |
| UCI_44 | RB483 | | x | 0.25 | | OXA-9; TEM-1 | UCI | Cerqueira et al, PNAS 2017 |
| UCI_61 | RB480 | | x | 32 | KPC-2 | SHV-134; TEM-1 | UCI | Cerqueira et al, PNAS 2017 |
| UCI_64 | RB541 | | x | 0.25 | | SHV-134 | UCI | Cerqueira et al, PNAS 2017 |
| UCI_7 | RB540 | | x | 0.25 | | SHV-134 | UCI | Cerqueira et al, PNAS 2017 |

| | | | KpCip | | | | |
|---|---|---|---|---|---|---|---|
| STAIN | Alt name 1 | Alt name 2 | Phase 1 | Phase 2 | cip MIC (mg/L) | Source | Comments |
| AR0034 | CarbaNP-03 | | | x | 1 | CDC | ARBank |
| AR0040 | CarbaNP-09 | RB408 | | x | 128 | CDC | ARBank |
| AR0076 | CarbaNP-45 | RB415 | x | | 0.5 | CDC | ARBank |
| AR0080 | CarbaNP-49 | RB416 | x | | <0.03 | CDC | ARBank |
| AR0126 | CRE-15 | | | x | 0.125 | CDC | ARBank |
| AR0160 | CRE-49 | | | x | 0.06 | CDC | ARBank |
| BAC0800005950 | RB592 | | x | | 0.25 | NYDOH | shared by K. Musser |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | |
|---|---|---|---|---|---|---|
| BIDMC_21 | RB563 | | x | 64 | BIDMC | Cerqueira et al, PNAS 2017 |
| BIDMC_22 | RB564 | | x | 0.03 | BIDMC | Cerqueira et al, PNAS 2017 |
| BIDMC_31 | RB565 | | x | 0.125 | BIDMC | Cerqueira et al, PNAS 2017 |
| BIT-03 | RB400 | x | | 32 | CDC | precursor to ARBank strain collection, shared by J. Patel |
| BIT-04 | RB401 | x | | 16 | CDC | precursor to ARBank strain collection, shared by J. Patel |
| BIT-05 | RB402 | x | | 128 | CDC | precursor to ARBank strain collection, shared by J. Patel |
| BIT-10 | RB403 | x | | | CDC | precursor to ARBank strain collection, shared by J. Patel |
| BIT-16 | RB405 | x | | 0.5 | CDC | precursor to ARBank strain collection, shared by J. Patel |
| BWH_15 | RB268 | x | | 0.125 | BWH | Cerqueira et al, PNAS 2017 |
| BWH_22 | RB287 | | x | 64 | BWH | Cerqueira et al, PNAS 2017 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | |
|---|---|---|---|---|---|---|
| CDC_1500476 | RB418 | x | | 1 | CDC | precursor to ARBank strain collection, shared by J. Patel |
| CDC_1500610 | RB419 | | x | 16 | CDC | precursor to ARBank strain collection, shared by J. Patel |
| IDR1200022727 | RB595 | x | | >32 | NYDOH | shared by K. Musser |
| IDR1600031102-01-00 | RB579 | | x | 64 | NYDOH | shared by K. Musser |
| IDR1600037319-01-00 | RB582 | | x | >32 | NYDOH | shared by K. Musser |
| IDR1600039511-01-00 | RB578 | x | | >32 | NYDOH | shared by K. Musser |
| IDR1600053363-01-00 | RB583 | | x | 16 | NYDOH | shared by K. Musser |
| MGH_18 | RB274 | | x | 0.125 | MGH | Cerqueira et al, PNAS 2017 |
| MGH_21 | RB277 | | x | 0.125 | MGH | Cerqueira et al, PNAS 2017 |
| MGH_35 | RB543 | | x | 64 | MGH | Cerqueira et al, PNAS 2017 |
| MGH_39 | RB780 | | x | 0.06 | MGH | Cerqueira et al, PNAS 2017 |
| MGH_74 | RB572 | | x | 0.03 | MGH | Cerqueira et al, PNAS 2017 |
| RB013 | | x (deriv_R) | x (deriv_R) | 128 | BWH | this paper |
| RB039 | | x (deriv_R) | x (deriv_R) | 128 | BWH | this paper |
| RB040 | | x (deriv_S) | x (deriv_S) | <0.03 | BWH | this paper |
| RB041 | | x (deriv_S) | x (deriv_S) | <0.03 | BWH | this paper |
| RB122 | | x | | 2 | BWH | this paper |
| RB123 | | x | | <0.03 | BWH | this paper |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | |
|---|---|---|---|---|---|
| UCI_20 | RB568 | x | 0.06 | UCI | Cerqueira et al, PNAS 2017 |
| UCI_22 | RB569 | x | 64 | UCI | Cerqueira et al, PNAS 2017 |
| UCI_37 | RB290 | x | 64 | UCI | Cerqueira et al, PNAS 2017 |
| UCI_56 | RB571 | x | 0.125 | UCI | Cerqueira et al, PNAS 2017 |

| STRAIN | Alt name 1 | Alt name 2 | KpGent Phase 1 | KpGent gent MIC (mg/L) | Source | Comments |
|---|---|---|---|---|---|---|
| AR0042 | CarbaNP-11 | RB410 | x | 32 | CDC | ARBank |
| AR0043 | CarbaNP-12 | RB411 | x | 1 | CDC | ARBank |
| AR0076 | CarbaNP-45 | RB415 | x | 32 | CDC | ARBank |
| AR0080 | CarbaNP-49 | RB416 | x | 2 | CDC | ARBank |
| ATCC 700721 | RB435 | | x | >32 | ATCC | |
| BAC0800007138 | RB594 | | x | 0.5 | NYDOH | shared by K. Musser |
| BIDMC_2A | RB469 | | x | 2 | BIDMC | Cerqueira et al, PNAS 2017 |
| BIDMC_34 | RB456 | | x | 32 | BIDMC | Cerqueira et al, PNAS 2017 |
| BIT-10 | RB403 | | x | 4 | CDC | precursor to ARBank strain collection, shared by J. Patel |
| BWH_15 | RB268 | | x | 4 | BWH | Cerqueira et al, PNAS 2017 |
| IDR1600031102-01-00 | RB579 | | x | >32 | NYDOH | shared by K. Musser |
| IDR1600039511-01-00 | RB578 | | x | 0.5 | NYDOH | shared by K. Musser |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| STRAIN | Alt name 1 | Alt name 2 | EcMero Phase 1 | EcMero mero MIC (mg/L) | CRE Known gene(s) in probeset | CRE Other known bla gene(s) | Source | Comments |
|---|---|---|---|---|---|---|---|---|
| MGH_30 | RB278 | | x | 1 | | | MGH | Cerqueira et al, PNAS 2017 |
| MGH_35 | RB543 | | x | >16 | | | MGH | Cerqueira et al, PNAS 2017 |
| MGH_63 | RB545 | | x | >16 | | | MGH | Cerqueira et al, PNAS 2017 |
| RB012 | | | x (deriv_R) | 32 | | | BWH | this paper |
| RB040 | | | x (deriv_S) | 0.5 | | | BWH | this paper |
| RB042 | | | x | 2 | | | BWH | this paper |
| RB121 | | | x (deriv_S) | 1 | | | BWH | this paper |
| RB122 | | | x (deriv_R) | 128 | | | BWH | this paper |
| UCI_13 | RB487 | | x | 0.5 | | | UCI | Cerqueira et al, PNAS 2017 |
| UCI_37 | RB290 | | x | 16 | | | UCI | Cerqueira et al, PNAS 2017 |
| UCI_63 | RB481 | | x | 4 | | | UCI | Cerqueira et al, PNAS 2017 |
| UCI_67 | RB484 | | x | 8 | | | UCI | Cerqueira et al, PNAS 2017 |
| UCI_7 | RB540 | | x | 0.5 | | | UCI | Cerqueira et al, PNAS 2017 |
| AR0048 | CarbaNP-17 | RB420 | x (deriv_R) | 32 | NDM-1; CTX-M-15 | TEM-1B; CMY-6; OXA-1 | CDC | ARBank |
| AR0055 | CarbaNP-24 | | x | 8 | NDM-1 | CMY-6; OXA-1 | CDC | ARBank |
| AR0058 | CarbaNP-27 | | x | 0.25 | | TEM-52B | CDC | ARBank |
| AR0061 | CarbaNP-30 | | x | 8 | KPC-3 | OXA-9; TEM-1A | CDC | ARBank |
| AR0069 | CarbaNP-38 | RB421 | x (deriv_R) | 16 | NDM-1 | TEM-1B; CMY-6 | CDC | ARBank |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | |
|---|---|---|---|---|---|---|---|---|
| AR0077 | CarbaNP-46 | | x | 0.5 | | | CDC | ARBank |
| AR0089 | CarbaNP-58 | | x | 0.5 | | CMY-2 | CDC | ARBank |
| AR0104 | CarbaNP-73 | | x | 1* | KPC-4 | TEM-1A | CDC | ARBank |
| BAA2469 | RB557 | | x | 16 | NDM-1 | | ATCC | |
| BAA2523 | RB553 | | x | 0.5* | OXA-48 | | ATCC | |
| BIDMC_77 | RB827 | | x | 0.5 | CTX-M-15 | CFE-1; OXA-30 | BIDMC | Cerqueira et al, PNAS 2017 |
| IDR1200024571 | RB597 | | x | >32 | | CMY-2 | NYDOH | shared by K. Musser |
| IDR1200039757 | RB598 | | x | >32 | | CMY-2 | NYDOH | shared by K. Musser |
| IDR1300027657 | RB602 | | x | 1 | | CMY-2 | NYDOH | shared by K. Musser |
| IDR1600029769 | RB585 | | x | 8 | OXA-48 | | NYDOH | shared by K. Musser |
| IDR1600035372 | RB586 | | x | 0.5 | CTX-M-15 | | NYDOH | shared by K. Musser |
| IDR1600043633 | RB589 | | x | 2 | CTX-M-15 | | NYDOH | shared by K. Musser |
| MGH_57 | RB544 | | x | 4 | CTX-M-15 | CFE-1; TEM-1 | MGH | Cerqueira et al, PNAS 2017 |
| RB001 | | | x (deriv_S) | 0.25 | | | BWH | this paper |
| RB002 | | | x (deriv_S) | 0.25 | | | BWH | this paper |
| RB076 | | | x | ≤0.5 | | | BWH | this paper |
| RB156 | | | x | 1 | | | BWH | this paper |
| RB765 | | | x | >32 | NDM; KPC | | MGH | this paper |
| RB767 | | | x | >32 | NDM | | MGH | this paper |
| UCI_51 | RB828 | | x | 4 | CTX-M-15 | bl1_ec; OXA-30; TEM-1 | UCI | Cerqueira et al, PNAS 2017 |

| | | | EcCip | | | |
|---|---|---|---|---|---|---|
| STRAIN | Alt name 1 | Alt name 2 | Phase 1 | cip MIC (mg/L) | Source | Comments |
| AR0061 | CarbaNP-30 | | x | 0.25 | CDC | ARBank |
| AR0081 | CarbaNP-50 | | x | 16 | CDC | ARBank |
| AR0085 | CarbaNP-54 | | x | 16 | CDC | ARBank |
| AR0089 | CarbaNP-58 | | x | 0.25 | CDC | ARBank |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | |
|---|---|---|---|---|---|
| AR0104 | CarbaNP-73 | x | 32 | CDC | ARBank |
| BAA2469 | RB557 | x | 64 | ATCC | |
| BAA2523 | RB553 | x | 0.5 | ATCC | |
| BAC0800005647 | RB591 | x | 64 | NYDOH | shared by K. Musser |
| IDR1200024571 | RB597 | x | 0.5 | NYDOH | shared by K. Musser |
| IDR1300034680 | RB603 | x | 0.03 | NYDOH | shared by K. Musser |
| RB001 | | x (deriv_S) | 0.03 | BWH | this paper |
| RB025 | | x | 0.25 | BWH | this paper |
| RB051 | | x (deriv_R) | 64 | BWH | this paper |
| RB057 | | x (deriv_R) | 64 | BWH | this paper |
| RB075 | | x (deriv_S) | 0.03 | BWH | this paper |
| RB077 | | x | 1 | BWH | this paper |
| RB086 | | x | 64 | BWH | this paper |
| RB110 | | x | 8 | BWH | this paper |

| | | | EcGent | | | |
|---|---|---|---|---|---|---|
| STRAIN | Alt name 1 | Alt name 2 | Phase 1 | gent MIC (mg/L) | Source | Comments |
| AR0055 | CarbaNP-24 | | x | 64 | CDC | ARBank |
| AR0061 | CarbaNP-30 | | x | 32 | CDC | ARBank |
| AR0081 | CarbaNP-50 | | x | 0.5 | CDC | ARBank |
| AR0084 | CarbaNP-53 | | x | 0.5 | CDC | ARBank |
| AR0085 | CarbaNP-54 | | x | 2 | CDC | ARBank |
| BAA2469 | RB557 | | x | 64 | ATCC | |
| BAC0800005647 | RB591 | | x | 1 | NYDOH | shared by K. Musser |
| IDR1300027657 | RB602 | | x | 64 | NYDOH | shared by K. Musser |
| IDR1300034680 | RB603 | | x | 1 | NYDOH | shared by K. Musser |
| IDR1600047120 | RB590 | | x | 64 | NYDOH | shared by K. Musser |
| MGH_57 | RB544 | | x | 0.5 | MGH | Cerqueira et al, PNAS 2017 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | |
|---|---|---|---|---|
| RB001 | x (deriv_S) | 1 | BWH | this paper |
| RB051 | x (deriv_R) | 256 | BWH | this paper |
| RB057 | x (deriv_R) | 256 | BWH | this paper |
| RB075 | x (deriv_S) | 0.5 | BWH | this paper |
| RB076 | x | 1 | BWH | this paper |
| RB765 | x | 64 | MGH | this paper |

| | | | AbMero | | CRE | | | |
|---|---|---|---|---|---|---|---|---|
| STRAIN | Alt name 1 | Alt name 2 | Phase 1 | mero MIC (mg/L) | Known gene(s) in probeset | Other known bla gene(s) | Source | Comments |
| ATCC 17978 | RB651 | | x | <0.5 | | OXA-95 | ATCC | |
| AR0033 | CarbaNP-02 | RB389 | x | >32 | NDM-1 | OXA-94 | CDC | ARBank |
| AR0035 | CarbaNP-04 | RB390 | x | >32 | | TEM-1D; ADC-25; OXA-66; OXA-72 | CDC | ARBank |
| AR0036 | CarbaNP-05 | RB425 | x | 16 | | OXA-65; OXA-24 | CDC | ARBank |
| AR0037 | CarbaNP-06 | RB391 | x | >32 | NDM-1 | OXA-94 | CDC | ARBank |
| AR0045 | CarbaNP-14 | RB392 | x | 32 | | TEM-1D; OXA-23; OXA-69 | CDC | ARBank |
| AR0052 | CarbaNP-21 | RB393 | x | 2 | | OXA-58; OXA-100 | CDC | ARBank |
| AR0056 | CarbaNP-25 | RB394 | x | >32 | | OXA-23; OXA-66 | CDC | ARBank |
| AR0063 | CarbaNP-32 | RB395 | x | 4 | | OXA-23; OXA-24; OXA_65 | CDC | ARBank |
| AR0070 | CarbaNP-39 | RB396 | x | 16 | | OXA-58; OXA-100 | CDC | ARBank |
| AR0078 | CarbaNP-47 | RB397 | x | >32 | | ADC-25; SHV-5; OXA-71 | CDC | ARBank |
| AR0101 | CarbaNP-70 | RB398 | x | >32 | | OXA-65; OXA-24 | CDC | ARBank |
| AR0102 | CarbaNP-71 | RB399 | x | 4 | | ADC-25; OXA-66 | CDC | ARBank |
| RB197 | | | x (deriv_S) | <0.5 | | | BWH | this paper |
| RB197s | | | x | ≤0.5 | | | BWH | this paper, small colony morphotype of RB197 |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | |
|---|---|---|---|---|---|---|
| RB198 | | | x | 8 | BWH | this paper |
| RB200 | | | x (deriv_R) | >32 | BWH | this paper |
| RB201 | | | x (deriv_S) | 0.25 | BWH | this paper |
| RB202 | | | x | 32 | BWH | this paper |
| RB203 | | | x (deriv_R) | >32 | BWH | this paper |
| RB204 | | | x | 16 | BWH | this paper |
| RB205 | | | x | 1 | BWH | this paper |
| RB206 | | | x | 1 | BWH | this paper |

| | | | AbCip | | | |
|---|---|---|---|---|---|---|
| STRAIN | Alt name 1 | Alt name 2 | Phase 1 | cip MIC (mg/L) | Source | Comments |
| ATCC 17978 | RB651 | | x | 0.5 | ATCC | |
| AR0033 | CarbaNP-02 | RB389 | x | >32 | CDC | ARBank |
| AR0035 | CarbaNP-04 | RB390 | x | >32 | CDC | ARBank |
| AR0036 | CarbaNP-05 | RB425 | x | >32 | CDC | ARBank |
| AR0037 | CarbaNP-06 | RB391 | x | >32 | CDC | ARBank |
| AR0045 | CarbaNP-14 | RB392 | x | >32 | CDC | ARBank |
| AR0052 | CarbaNP-21 | RB393 | x | 4 | CDC | ARBank |
| AR0056 | CarbaNP-25 | RB394 | x | >32 | CDC | ARBank |
| AR0063 | CarbaNP-32 | RB395 | x | 8 | CDC | ARBank |
| AR0070 | CarbaNP-39 | RB396 | x | 8 | CDC | ARBank |
| AR0078 | CarbaNP-47 | RB397 | x | >32 | CDC | ARBank |
| AR0101 | CarbaNP-70 | RB398 | x | >32 | CDC | ARBank |
| AR0102 | CarbaNP-71 | RB399 | x | >32 | CDC | ARBank |
| RB197 | | | x x x (deriv_S) | 0.25 | BWH | this paper |
| RB197s | | | x | 0.25 | BWH | this paper; small colony morphotype of RB197 |
| RB198 | | | x (deriv_R) | >32 | BWH | this paper |
| RB201 | | | x x (deriv_S) | 0.25 | BWH | this paper |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| STRAIN | Alt name 1 | Alt name 2 | AbGent Phase 1 | AbGent gent MIC (mg/L) | Source | Comments |
|---|---|---|---|---|---|---|
| RB202 | | | x (deriv_R) | >32 | BWH | this paper |
| RB203 | | | x | >32 | BWH | this paper |
| RB204 | | | x | >32 | BWH | this paper |
| RB205 | | | x | 1 | BWH | this paper |
| RB206 | | | x | >32 | BWH | this paper |
| ATCC 17978 | RB651 | | x | ≤0.5 | ATCC | |
| AR0033 | CarbaNP-02 | RB389 | x | 32 | CDC | ARBank |
| AR0035 | CarbaNP-04 | RB390 | x | 16 | CDC | ARBank |
| AR0037 | CarbaNP-06 | RB391 | x | >32 | CDC | ARBank |
| AR0045 | CarbaNP-14 | RB392 | x | >32 | CDC | ARBank |
| AR0052 | CarbaNP-21 | RB393 | x | 32 | CDC | ARBank |
| AR0056 | CarbaNP-25 | RB394 | x | >32 | CDC | ARBank |
| AR0063 | CarbaNP-32 | RB395 | x | 4 | CDC | ARBank |
| AR0070 | CarbaNP-39 | RB396 | x | >32 | CDC | ARBank |
| AR0078 | CarbaNP-47 | RB397 | x | >32 | CDC | ARBank |
| AR0101 | CarbaNP-70 | RB398 | x | 8 | CDC | ARBank |
| AR0102 | CarbaNP-71 | RB399 | x | >32 | CDC | ARBank |
| RB197 | | | x (deriv_S) | ≤0.5 | BWH | this paper |
| RB198 | | | x | >32 | BWH | this paper |
| RB200 | | | x (deriv_R) | >32 | BWH | this paper |
| RB201 | | | x | 1 | BWH | this paper |
| RB202 | | | x | >32 | BWH | this paper |
| RB203 | | | x | 4 | BWH | this paper |
| RB204 | | | x (deriv_R) | >32 | BWH | this paper |
| RB205 | | | x (deriv_S) | 2 | BWH | this paper |
| RB206 | | | x | >32 | BWH | this paper |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | KpMero | | | CRE | | | | KpGent | | |
|---|---|---|---|---|---|---|---|---|---|---|
| STRAIN | Phase 1 | Phase 2 | mero MIC (mg/L) | Run? | Known gene(s) in probset | Other known bla gene(s) | Found by | Phase 1 | gent MIC (mg/L) | Used in blood cultures? |
| AR0034 | | x | 2 | + | IMP-4 | TEM-1B; SHV-11 | WGS | | | |
| AR0040 | x | (x) | >32 | + | VIM-27; CTX-M-15 | SHV-11; OXA-1 | WGS | | | |
| AR0041 | | x x | 16 | + | NDM-1; CTX-M-15; OXA-10 | CMY-4; SHV-11 | WGS | | | |
| AR0042 | x | (x) | ≤0.5 | + | CTX-M15; OXA-10 | TEM-1B; SHV-1; OXA-1 | WGS | x | 32 | |
| AR0043 | x | | 2 | – | | SHV-12 | WGS | x | 1 | |
| AR0044 | | x | 4 | + | CTX-M-15 | OXA-9; TEM-1A; SHV-12; OXA-1 | WGS | | | |
| AR0047 | | x | 4 | + | | TEM-1A | WGS | | | |
| AR0075 | x | (x) | 8 | + | CTX-M15 | OXA-232; SHV-1; OXA-1 | WGS | | | x |
| AR0076 | | | | | | | | x | 32 | |
| AR0080 | | | | | | | | x | 2 | x |
| AR0087 | x | (x) | 1 | + | | SHV-12 | WGS | | | |
| AR0126 | | | | | | | | | | |
| AR0135 | | x | 8 | + | VIM-1 | OXA-9; TEM-1A; SHV-12 | WGS | | | |
| AR0139 | | | | | | | | | | |
| AR0160 | | x x | 32 | + | NDM-1; CTX-M-15; OXA-10 | CMY-4; SHV-11 | WGS | | | |
| ATCC 700721 | | | | | | | | x | <32 | |
| BAA2524 | | x | 0.5* | + | OXA-48 | | unknown | | | |
| BAC0800005950 | | | | | | | | | | |
| BAC0800007138 | | | | | | | | x | 0.5 | |
| BIDMC_14 | | x | 16 | + | KPC-3 | SHV-134; TEM-1 | WGS | | | x |
| BIDMC_21 | | | | | | | | | | |
| BIDMC_22 | | x | 0.25 | + | | SHV-134 | WGS | | | |
| BIDMC_2A | | | | | | | | x | 2 | |
| BIDMC_31 | | x | 0.125 | + | | SHV-38 | WGS | | | |
| BIDMC_34 | | | | | | | | x | 32 | x |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | | | |
|---|---|---|---|---|---|---|---|---|---|---|
| BIDMC_35 | x | (x) | >32 | + | OXA-10 | SHV-134 | WGS | | | |
| BIT-03 | x | (x) | 8 | + | KPC (unknown type) | | unknown | | | |
| BIT-04 | x (deriv_R) | x (deriv_R) | 32 | + | KPC (unknown type) | | unknown | | | |
| BIT-05 | x | (x) | >32 | − | KPC (unknown type) | | unknown | | | |
| BIT-10 | | | | | | | | x | 4 | |
| BIT-12 | x | (x) | ≤0.5 | + | | | unknown | | | |
| BIT-16 | x | (x) | ≤0.5 | + | | | unknown | | | x |
| BWH_15 | x | (x) | 8 | + | KPC-4 | SHV-134; TEM-1 | WGS | x | 4 | |
| BWH_2 | | x | 16 | + | CTX-M-15; OXA-48 | OXA-30; OXA-9; SHV-38; TEM-1 | WGS | | | |
| BWH_22 | | | | | | | | | | x |
| BWH_30 | x | (x) | ≤0.5 | − | | SHV-134 | WGS | | | |
| BWH_36 | x | (x) | 16 | + | KPC-3 | SHV-134; TEM-1 | WGS | | | |
| CDC_1500476 | | | | | | | | | | |
| CDC_1500610 | x | (x) | ≤0.5 | + | | | (no data) | | | |
| IDR1200022727 | | | | | | | | | | |
| IDR1200023303 | x | (x) | >32 | + | | SHV-38 | WGS | | | |
| IDR1600031102-01-00 | x | (x) | >32 | + | NDM-1; CTX-M15 | | WGS | x | >32 | |
| IDR1600037310 | x | (x) | 1 | + | CTX-M-15 | | WGS | | | |
| IDR1600037319-01-00 | | | | | | | | | | |
| IDR1600039511-01-00 | | | | | | | | x | 0.5 | |
| IDR1600053363-01-00 | | | | | | | | | | |
| IDR1600057468-01-00 | | x | 4 | + | CTX-M-15 | | WGS | | | |
| MGH_17 | | x | ≤0.5 | + | | SHV-134 | WGS | | | |
| MGH_18 | x (deriv_S) | x (deriv_S) | ≤0.5 | + | | SHV-134 | WGS | | | |
| MGH_19 | x | (x) | ≤0.5 | + | | SHV-134 | WGS | | | |
| MGH_20 | | x | ≤0.5 | + | | SHV-134 | WGS | | | |
| MGH_21 | | | | | | | | | | |
| MGH_30 | | | | | | | | x | 1 | |
| MGH_31 | | x | 8 | + | | SHV-134 | WGS | | | |
| MGH_35 | | x | 2 | + | CTX-M-15 | OXA-30; SHV-134; TEM-1 | WGS | x | >16 | |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | | | | | | | | | | |
|---|---|---|---|---|---|---|---|---|---|---|
| MGH_36 | | x | ≤0.5 | + | | SHV-38 | WGS | | | |
| MGH_39 | | x | 2 | + | KPC-3 | OXA-9; SHV-38; TEM-1 | WGS | | | |
| MGH_48 | | x | ≤0.5 | + | | SHV-134 | WGS | | | |
| MGH_63 | | | | | | | | x | >16 | x |
| MGH_71 | | x | 32 | + | KPC-2; OXA-10 | SHV-134; TEM-1 | WGS | | | |
| MGH_74 | | | | | | | | | | x |
| RB012 | | | | | | | | x (deriv_R) | 32 | |
| RB013 | | | | | | | | | | |
| RB039 | x (deriv_S) | x (deriv_S) | ≤0.5 | + | | | (no data) | | | |
| RB040 | | | | | | | | x (deriv_S) | 0.5 | |
| RB041 | | x | ≤0.5 | + | | | (no data) | | | x |
| RB042 | | x | ≤0.5 | + | | | (no data) | x | 2 | |
| RB121 | | | | | | | | x (deriv_S) | 1 | |
| RB122 | | | | | | | | x (deriv_R) | 128 | |
| RB123 | | | | | | | | | | x |
| UCI_13 | | | | | | | | x | 0.5 | |
| UCI_19 | x (deriv_R) | x (deriv_R) | >32 | + | KPC-2 | SHV-134; TEM-1 | WGS | | | |
| UCI_20 | | | | | | | | | | |
| UCI_22 | | | | | | | | | | |
| UCI_37 | x | (x) | 32 | + | KPC-3 | OXA-9; SHV-38; TEM-1 | WGS | x | 16 | |
| UCI_38 | x | (x) | ≤0.5 | + | | SHV-134 | WGS | | | |
| UCI_44 | | x | 0.25 | + | | OXA-9; TEM-1 | WGS | | | |
| UCI_56 | | | | | | | | | | |
| UCI_61 | | x | 32 | + | KPC-2 | SHV-134; TEM-1 | WGS | | | |
| UCI_63 | | | | | | | | x | 4 | |
| UCI_64 | | x | 0.25 | + | | SHV-134 | WGS | | | x |
| UCI_67 | | | | | | | | x | 8 | x |
| UCI_7 | | x | 0.25 | + | | SHV-134 | WGS | x | 0.5 | |

TABLE 7-continued

Strains used in this study (including origin, and which assay(s) they were used in), with MIC measurements. Highlight those used for RNA-Seq, and which were used for which NSTG assay, and which were used as "derivation" or "validation" in ML algorithms and for SPD.

| | EcCip | | EcGent | | |
|---|---|---|---|---|---|
| STRAIN | Phase 1 | cip MIC (mg/L) | Phase 1 | gent MIC (mg/L) | Used in blood cultures? |
| AR0048 | | | | | |
| AR0055 | | | x | 64 | x |
| AR0058 | | | | | |
| AR0061 | x | 0.25 | x | 32 | x |
| AR0077 | | | | | x |
| AA0081 | x | 16 | x | 0.5 | |
| AA0084 | | | x | 0.5 | |
| AR0085 | x | 16 | x | 2 | |
| AR0089 | x | 0.25 | | | x |
| AR0104 | x | 32 | | | |
| BAA2469 | x | 64 | x | 64 | |
| BAA2523 | x | 0.5 | | | |
| BAC08000005647 | x | 64 | x | 1 | x |
| BIDMC_77 | | | | | |
| IDR1200024571 | x | 0.5 | | | |
| IDR1200039757 | | | | | |
| IDR1300027657 | | | x | 64 | |
| IDR1300034680 | x | 0.03 | x | 1 | x |
| IDR1600029769 | | | | | |
| IDR1600035372 | | | | | |
| IDR1600043633 | | | | | |
| IDR1600047120 | | | x | 64 | |
| MGH_57 | | | x | 0.5 | |
| RB001 | x (deriv_S) | 0.03 | x (deriv_S) | 1 | |
| RB002 | | | | | |
| RB025 | x | 0.25 | | | |
| RB051 | x (deriv_r) | 64 | x (deriv_R) | 256 | x |
| RB057 | x (deriv_r) | 64 | x (deriv_R) | 256 | x |
| RB075 | x (deriv_S) | 0.03 | x (deriv_S) | 0.5 | |
| RB076 | | | x | 1 | x |
| RB077 | x | 1 | | | |
| RB086 | x | 64 | | | x |
| RB110 | x | 8 | | | |
| RB156 | | | | | x |
| RB765 | | | x | 64 | |
| RB767 | | | | | |
| UCI_51 | | | | | |
| BAA2471 | | | | | x |

| | EcCip | | EcGent | | |
|---|---|---|---|---|---|
| STRAIN | Phase 1 | cip MIC (mg/L) | Phase 1 | gent MIC (mg/L) | Used in blood cultures? |
| AR0048 | | | | | |
| AR0055 | | | x | 64 | x |
| AR0058 | | | | | |
| AR0061 | x | 0.25 | x | 32 | x |
| AR0069 | | | | | x |
| AR0077 | | | | | |
| AR0081 | x | 16 | x | 0.5 | |
| AR0084 | | | x | 0.5 | |
| AR0085 | x | 16 | x | 2 | |
| AR0089 | x | 0.25 | | | x |
| AR0104 | x | 32 | | | |
| BAA2469 | x | 64 | x | 64 | |
| BAA2523 | x | 0.5 | | | |
| BAC0800005647 | x | 64 | x | 1 | x |
| BIDMC_77 | | | | | |
| IDR1200024571 | x | 0.5 | | | |
| IDR1200039757 | | | | | |
| IDR1300027657 | | | x | 64 | |
| IDR1300034680 | x | 0.03 | x | 1 | x |
| IDR1600029769 | | | | | |
| IDR1600035372 | | | | | |
| IDR1600043633 | | | | | |
| IDR1600047120 | | | x | 64 | |
| MGH_57 | | | x | 0.5 | |
| RB001 | x<br>(deriv_S) | 0.03 | x<br>(deriv_S) | 1 | |
| RB002 | | | | | |
| RB025 | x | 0.25 | | | |
| RB051 | x<br>(deriv_R) | 64 | x<br>(deriv_R) | 256 | x |
| RB057 | x<br>(deriv_R) | <br>64 | x<br>(deriv_R) | 256 | x |
| RB075 | x<br>(deriv_S) | <br>0.03 | x<br>(deriv_S) | 0.5<br>1 | <br>x |
| RB076 | | | x | | |
| RB077 | x | 1 | | | |
| RB086 | x | 64 | | | x |
| RB110 | x | 8 | | | |
| RB156 | | | | | x |
| RB765 | | | x | 64 | |
| RB767 | | | | | |
| UCl_51 | | | | | |
| BAA2471 | | | | | x |

| | AbCip | | AbGent | |
|---|---|---|---|---|
| STRAIN ATCC | Phase 1 | cip MIC (mg/L) | Phase 1 | gent MIC (mg/L) |
| 17978 | x | 0.5 | x | ≤0.5 |
| AR0033 | x | >32 | x | 32 |
| AR0035 | x | >32 | x | 16 |
| AR0036 | x | >32 | x | |
| AR0037 | x | >32 | x | >32 |
| AR0045 | x | >32 | x | >32 |
| AR0052 | x | 4 | x | 32 |
| AR0056 | x | >32 | x | >32 |
| AR0063 | x | 8 | x | 4 |
| AR0070 | x | 8 | x | >32 |
| AR0078 | x | >32 | x | >32 |
| AR0101 | x | >32 | x | 8 |
| AR0102 | x | >32 | x | >32 |
| RB197 | xxx<br>(deriv_S) | 0.25 | x<br>(deriv_S) | ≤0.5 |
| RB197s | x | 0.25 | | |
| RB198 | x<br>(deriv_R) | >32 | x | 32 |

-continued

| | AbCip | | AbGent | |
|---|---|---|---|---|
| STRAIN ATCC | Phase 1 | cip MIC (mg/L) | Phase 1 | gent MIC (mg/L) |
| RB200 | | | x<br>(deriv_R) | >32 |
| RB201 | xx<br>(deriv_S) | 0.25 | x | 1 |
| RB202 | x<br>(deriv_R) | >32 | x | >32 |
| RB203 | x | >32 | x | 4 |
| RB204 | x | >32 | x<br>(deriv_R) | >32 |
| RB205 | x | 1 | x<br>(deriv_S) | 2 |
| RB206 | x | >32 | x | >32 |

| STRAIN | Alt name 1 | PaCip Phase 1 | PaCip cip MIC (mg/L) | Source | Comments |
|---|---|---|---|---|---|
| BL01 | RB918 | x | 0.125 | B&L | eye isolate |
| BL03 | RB919 | x | 16 | B&L | eye isolate |
| BL08 | RB920 | x | 0.06 | B&L | eye isolate |
| BL11 | RB921 | x | 0.125 | B&L | eye isolate |
| BL17 | RB922 | x | 16 | B&L | eye isolate |
| BL22 | RB923 | x | 0.5 | B&L | eye isolate |
| BWHPSA003 | RB294 | x | 16 | BWH | clinical pulmonary isolate |
| BWHPSA006 | RB925 | x | 16 | BWH | clinical pulmonary isolate |
| BWH029 | RB926 | x | 0.03 | BWH | clinical pulmonary isolate |
| BWH033 | RB927 | x | 0.06 | BWH | clinical urinary isolate |
| BWHPSA041 | RB928 | x | 2 | BWH | clinical wound isolate |
| BWHPSA043 | RB929 | x | 0.06 | BWH | clinical wound isolate |
| BWHPSA046 | RB930 | x | 0.06 | BWH | clinical pulmonary isolate |
| BWHPSA048 | RB931 | x | 8 | BWH | clinical urinary isolate |
| BWH049 | RB932 | x | 16 | BWH | clinical urinary isolate |
| BWH050 | RB933 | x | 0.25 | BWH | clinical blood isolate |
| BWH053 | RB934 | x | 16 | BWH | clinical blood isolate |
| BWH055 | RB935 | x | 0.125 | BWH | clinical urinary isolate |
| CF5 | RB936 | x | 8 | Lory lab | respiratory isolate from CF patient from Lory lab via Aussubel lab |
| CF18 | RB937 | x | 0.06 | Lory lab | respiratory isolate from CF patient from Lory lab via Aussubel lab |
| CF27 | RB938 | X | 1 | Lory lab | respiratory isolate from CF patient from Lory lab via Aussubel lab |
| UDL | RB939 | x | 0.125 | Lory lab | urinary isolate from Lory lab via Aussubel lab |
| X13273 | RB940 | x | 8 | Lory lab | blood isolate from Lory lab via Aussubel lab |
| X24509 | RB941 | x | 64 | Lory lab | urinary isolate from Lory lab via Aussubel lab |

| STRAIN | SaLevo Phase 1 | SaLevo levo MIC (mg/L) | Source | Comments |
|---|---|---|---|---|
| RB003 | x | 0.125 | BWH | clinical isolate from BWH |
| RB004 | x | 32 | BWH | clinical isolate from BWH |
| RB006 | x | 0.06 | BWH | clinical isolate from BWH Crimson Core |
| RB007 | x | 16 | BWH | clinical isolate from BWH Crimson Core |
| RB010 | x | >32 | BWH | clinical isolate from BWH Crimson Core |
| RB045 | x | 32 | BWH | clinical isolate from BWH Crimson Core |
| RB047 | x | >32 | BWH | clinical isolate from BWH Crimson Core |
| RB064 | x | 8 | BWH | clinical isolate from BWH Crimson Core |
| RB065 | x | 0.06 | BWH | clinical isolate from BWH Crimson Core |
| RB066 | x | 0.06 | BWH | clinical isolate from BWH Crimson Core |
| RB067 | x | 0.13 | BWH | clinical isolate from BWH Crimson Core |
| RB0069 | x | 0.13 | BWH | clinical isolate from BWH Crimson Core |
| RB072 | x | 4 | BWH | clinical isolate from BWH Crimson Core |
| RB074 | x | 32 | BWH | clinical isolate from BWH Crimson Core |
| RB090 | x | 32 | BWH | clinical isolate from BWH Crimson Core |
| RB095 | x | 32 | BWH | clinical isolate from BWH Crimson Core |

-continued

| STRAIN | SaLevo Phase 1 | SaLevo levo MIC (mg/L) | Source | Comments |
|---|---|---|---|---|
| RB096 | x | 0.13 | BWH | clinical isolate from BWH Crimson Core |
| RB098 | x | 0.13 | BWH | clinical isolate from BWH Crimson Core |
| RB211 | x | 16 | BWH | clinical isolate from BWH Crimson Core |
| RB219 | x | 32 | BWH | clinical isolate from BWH Crimson Core |
| RB221 | x | 0.13 | BWH | clinical isolate from BWH Crimson Core |
| RB223 | x | 0.13 | BWH | clinical isolate from BWH Crimson Core |
| RB245 | x | 0.25 | BWH | clinical isolate from BWH |
| RB247 | x | 0.5 | BWH | clinical isolate from BWH |

KEY/ABBREVIATIONS:

* large inoculum effect for meropenem MIC (RB554: MIC 0.5 at 1e5 cfu/mL, MIC 32 at 1e7 cfu/mL)

ATCC American Type Culture Collection

BWH Brigham and Women's Hospital, Boston MA USA

CDC United States Centers for Disease Control deriv_S susceptible strain used in RNA-Seq for derivation of responsive and control genes, and for derivation of "centroid" of susceptible strains for SPD calculations, defined as SPD := 0 (see Barczak, Gomez et al, PNAS 2012).

deriv_R resistant strain used in RNA-Seq for derivation of control genes, and for derivation of "centroid" of resistant strains for SPD calculations, defined as SPD := 0 (see Barczak, Gomez et al, PNAS 2012).

MGH Massachusetts General Hospital, Boston MA USA

NYDOH New York Department of Health (aka Wadsworth laboratories)

UCI Universities of California at Irvine, USA (x) non-derivation strain from phase 1 that was rerun in phase 2

Table 8: GO term enrichment summary (bold = enriched in two bacteria for the same drug; bold/red = enriched in all three bacteria for the same drug)

| **KpMero:** | category | over_represented_pvalue | under_represented_pvalue | numDEInCat | numInCat | term | ontology | BH.adjusted.pvalue |
|---|---|---|---|---|---|---|---|---|
| | GO:0009432 | 2.30E-07 | 1 | 13 | 30 | SOS response | BP | 6.75E-05 |
| | GO:0009245 | 7.11E-05 | 0.9999908 | 9 | 24 | lipid A biosynthetic process | BP | 0.010445386 |
| | GO:0009103 | 0.0002335 | 0.9999686 | 8 | 22 | **lipopolysaccharide biosynthetic process** | BP | 0.022882608 |
| | | | | | | | | |
| **KpCip:** | | | | | | | | |
| | GO:0009432 | 1.20E-11 | 1 | 19 | 30 | **SOS response** | BP | 3.52E-09 |
| | GO:0009246 | 7.42E-06 | 0.9999995 | 9 | 15 | enterobacterial common antigen biosynthetic process | BP | 0.001090988 |
| | GO:0045272 | 0.0002088 | 0.9999808 | 7 | 13 | **plasma membrane respiratory chain complex I** | CC | 0.020461935 |

| | | | | | | | | |
|---|---|---|---|---|---|---|---|---|
| **KpGent:** | | | | | | | | |
| | GO:0005829 | 4.52E-08 | 1 | 354 | 804 | cytosol | CC | 1.29E-05 |
| | GO:0042802 | 4.46E-07 | 1 | 139 | 279 | **identical protein binding** | MF | 6.38E-05 |
| | GO:0003677 | 1.42E-06 | 1 | 162 | 339 | DNA binding | MF | 0.0001353 |
| | GO:0006094 | 3.72E-05 | 1 | 12 | 13 | gluconeogenesis | BP | 0.0021253 |
| | GO:0045272 | 3.72E-05 | 1 | 12 | 13 | plasma membrane respiratory chain complex I | CC | 0.0021253 |
| | GO:0006096 | 0.0004 | 0.99993 | 15 | 20 | glycolytic process | BP | 0.015156 |
| | GO:0008137 | 0.0004 | 0.99993 | 15 | 20 | **NADH dehydrogenase (ubiquinone) activity** | MF | 0.015156 |
| | GO:0009246 | 0.00042 | 0.99996 | 11 | 13 | **enterobacterial common antigen biosynthetic process** | BP | 0.015156 |

| | | | | | | | | |
|---|---|---|---|---|---|---|---|---|
| | GO:0048038 | 0.00073 | 0.99989 | 13 | 17 | quinone binding | MF | 0.0232089 |
| | GO:0003700 | 0.00088 | 0.99944 | 116 | 257 | **transcription factor activity, sequence-specific DNA binding** | MF | 0.0232221 |
| | GO:0005515 | 0.00089 | 0.99935 | 247 | 594 | protein binding | MF | 0.0232221 |
| | GO:0051082 | 0.00195 | 0.99955 | 15 | 22 | unfolded protein binding | MF | 0.0465668 |
| | GO:0009252 | 0.00218 | 0.99921 | 25 | 43 | peptidoglycan biosynthetic process | BP | 0.0479236 |
| | GO:0006355 | 0.00245 | 0.99838 | 114 | 258 | **regulation of transcription, DNA-templated** | BP | 0.0499734 |
| | | | | | | | | |
| **EcMero:** | category | over_represented_pvalue | under_represented_pvalue | numDEInCat | numInCat | term | ontology | BH.adjusted.pvalue |

| | | | | | | | | |
|---|---|---|---|---|---|---|---|---|
| | GO:0045228 | 1.63E-10 | 1 | 10 | 10 | slime layer polysaccharide biosynthetic process | BP | 4.84E-08 |
| | GO:0009103 | 1.53E-08 | 1 | 18 | 39 | **lipopolysaccharide biosynthetic process** | BP | 2.26E-06 |
| | GO:0000160 | 1.20E-05 | 0.9999968 | 21 | 73 | phosphorelay signal transduction system | BP | 0.001179541 |
| | GO:0003700 | 8.05E-05 | 0.9999668 | 34 | 165 | transcription factor activity, sequence-specific DNA binding | MF | 0.005950885 |
| | GO:0000155 | 0.0001407 | 0.9999748 | 11 | 30 | phosphorelay sensor kinase activity | MF | 0.005950885 |
| | GO:0018106 | 0.0001407 | 0.9999748 | 11 | 30 | peptidyl-histidine phosphorylation | BP | 0.005950885 |

| | | | | | | | | |
|---|---|---|---|---|---|---|---|---|
| | GO:0023014 | 0.0001407 | 0.9999748 | 11 | 30 | signal transduction by protein phosphorylation | BP | 0.005950885 |
| | GO:0009408 | 0.000194 | 0.9999563 | 13 | 41 | **response to heat** | BP | 0.007176356 |
| | GO:0009242 | 0.0007007 | 0.9999106 | 7 | 16 | colanic acid biosynthetic process | BP | 0.023043956 |
| | GO:0042802 | 0.0010501 | 0.9994156 | 51 | 316 | identical protein binding | MF | 0.031083956 |
| | GO:0009097 | 0.0012302 | 0.9998603 | 6 | 13 | isoleucine biosynthetic process | BP | 0.033102869 |
| | GO:0006355 | 0.0016 | 0.9992615 | 28 | 149 | regulation of transcription, DNA-templated | BP | 0.039467343 |
| | | | | | | | | |
| **EcCip:** | | | | | | | | |
| | GO:0005829 | 5.89E-14 | 1 | 259 | 838 | cytosol | CC | 1.77E-11 |
| | GO:0045272 | 8.23E-08 | 1 | 12 | 13 | plasma membrane respiratory chain complex I | CC | 8.45E-06 |

| | | | | | | | | |
|---|---|---|---|---|---|---|---|---|
| | GO:0009432 | 1.04E-07 | 1 | 22 | 35 | SOS response | BP | 8.45E-06 |
| | GO:0048038 | 1.12E-07 | 1 | 13 | 15 | quinone binding | MF | 8.45E-06 |
| | GO:0005524 | 4.95E-07 | 0.9999997 | 142 | 468 | ATP binding | MF | 2.98E-05 |
| | GO:0042802 | 7.52E-06 | 0.9999959 | 98 | 312 | identical protein binding | MF | 0.000377223 |
| | GO:0005515 | 2.15E-05 | 0.999986 | 185 | 678 | protein binding | MF | 0.0008179 |
| | GO:0008137 | 2.17E-05 | 0.9999981 | 11 | 15 | **NADH dehydrogenase (ubiquinone) activity** | MF | 0.0008179 |
| | GO:0009060 | 7.64E-05 | 0.9999928 | 10 | 14 | **aerobic respiration** | BP | 0.002554494 |
| | GO:0009408 | 0.0001178 | 0.9999698 | 19 | 39 | response to heat | BP | 0.003544968 |
| | GO:0005737 | 0.0004105 | 0.9997398 | 107 | 379 | cytoplasm | CC | 0.011232616 |
| | GO:0003924 | 0.0010496 | 0.9997509 | 13 | 26 | GTPase activity | MF | 0.025792402 |
| | GO:0000287 | 0.001114 | 0.9993795 | 56 | 181 | magnesium ion binding | MF | 0.025792402 |
| | GO:0000049 | 0.0012322 | 0.9996029 | 18 | 42 | tRNA binding | MF | 0.026492746 |
| | GO:0006281 | 0.0013993 | 0.9995073 | 20 | 49 | DNA repair | BP | 0.028079213 |
| | GO:0006094 | 0.0018422 | 0.9997384 | 8 | 13 | gluconeogenesis | BP | 0.033095829 |
| | GO:0005525 | 0.0019593 | 0.9992409 | 22 | 57 | GTP binding | MF | 0.033095829 |

| | | | | | | | | |
|---|---|---|---|---|---|---|---|---|
| | GO:0008270 | 0.0019792 | 0.9989393 | 45 | 142 | zinc ion binding | MF | 0.033095829 |
| | | | | | | | | |
| | | | | | | | | |
| **EcGent:** | | | | | | | | |
| | GO:0005829 | 1.10E-10 | 1 | 292 | 838 | cytosol | CC | 3.32E-08 |
| | GO:0045272 | 9.19E-07 | 1 | 12 | 13 | plasma membrane respiratory chain complex I | CC | 0.000138358 |
| | GO:0048038 | 1.46E-06 | 0.9999999 | 13 | 15 | quinone binding | MF | 0.000146098 |
| | GO:0009408 | 2.88E-06 | 0.9999994 | 24 | 39 | response to heat | BP | 0.000216511 |
| | GO:0009060 | 4.90E-06 | 0.9999997 | 12 | 14 | **aerobic respiration** | BP | 0.000295219 |
| | GO:0000976 | 0.0001515 | 0.9999613 | 20 | 36 | **transcription regulatory region sequence-specific DNA binding** | MF | 0.007180246 |

| | | | | | | | | |
|---|---|---|---|---|---|---|---|---|
| | GO:0008137 | 0.000167 | 0.9999813 | 11 | 15 | **NADH dehydrogenase (ubiquinone) activity** | MF | 0.007180246 |
| | GO:0009246 | 0.0004784 | 0.9999418 | 10 | 14 | **enterobacterial common antigen biosynthetic process** | BP | 0.015360219 |
| | GO:0000160 | 0.0005103 | 0.9997895 | 33 | 75 | phosphorelay signal transduction system | BP | 0.015360219 |
| | GO:0045893 | 0.0005103 | 0.9997895 | 33 | 75 | **positive regulation of transcription, DNA-templated** | BP | 0.015360219 |
| | GO:0045892 | 0.000689 | 0.9996804 | 40 | 97 | **negative regulation of transcription, DNA-templated** | BP | 0.018272272 |

| | | | | | | | | |
|---|---|---|---|---|---|---|---|---|
| | GO:0042802 | 0.0007285 | 0.9995352 | 106 | 312 | **identical protein binding** | MF | 0.018272272 |
| | GO:0032993 | 0.0011444 | 0.9996019 | 22 | 46 | protein-DNA complex | CC | 0.025110664 |
| | GO:0005524 | 0.0011679 | 0.9991888 | 150 | 468 | **ATP binding** | MF | 0.025110664 |
| | GO:0051082 | 0.0018124 | 0.9995693 | 13 | 23 | unfolded protein binding | MF | 0.036369052 |
| | GO:0001216 | 0.0024028 | 0.9994473 | 12 | 21 | **bacterial-type RNA polymerase transcriptional activator activity, sequence-specific DNA binding** | MF | 0.045203227 |
| | GO:0000156 | 0.0026702 | 0.9992241 | 15 | 29 | phosphorelay response regulator activity | MF | 0.047278898 |
| | | | | | | | | |
| **AbMero:** | category | over_represented_pvalue | under_represented_pvalue | numDEInCat | numInCat | term | ontology | BH.adjusted.pvalue |

| | | | | | | | | |
|---|---|---|---|---|---|---|---|---|
| | GO:0003735 | 6.18E-25 | 1 | 38 | 56 | structural constituent of ribosome | MF | 9.02E-23 |
| | GO:0006412 | 1.02E-21 | 1 | 37 | 61 | translation | BP | 7.42E-20 |
| | GO:0022625 | 2.06E-19 | 1 | 26 | 34 | cytosolic large ribosomal subunit | CC | 1.00E-17 |
| | GO:0010124 | 1.12E-11 | 1 | 14 | 17 | phenylacetate catabolic process | BP | 4.07E-10 |
| | GO:0019843 | 5.58E-10 | 1 | 18 | 33 | rRNA binding | MF | 1.63E-08 |
| | GO:0000027 | 1.20E-09 | 1 | 15 | 24 | ribosomal large subunit assembly | BP | 2.93E-08 |
| | GO:0008137 | 2.95E-07 | 1 | 9 | 12 | NADH dehydrogenase (ubiquinone) activity | MF | 5.39E-06 |
| | GO:0045272 | 2.95E-07 | 1 | 9 | 12 | plasma membrane respiratory chain complex I | CC | 5.39E-06 |
| | GO:0022627 | 7.15E-06 | 0.9999993 | 10 | 19 | cytosolic small ribosomal subunit | CC | 0.000115922 |

| | | | | | | | | |
|---|---|---|---|---|---|---|---|---|
| | GO:0005515 | 2.53E-05 | 0.9999893 | 43 | 216 | protein binding | MF | 0.000368873 |
| | GO:0009408 | 0.000156 | 0.9999865 | 7 | 13 | **response to heat** | BP | 0.002069898 |
| | GO:0009060 | 0.001353 | 0.999844 | 6 | 13 | aerobic respiration | BP | 0.016461583 |
| | GO:0005887 | 0.0015257 | 0.9993957 | 21 | 99 | integral component of plasma membrane | CC | 0.01713523 |
| | GO:0006635 | 0.0032705 | 0.9995175 | 6 | 15 | fatty acid beta-oxidation | BP | 0.031887682 |
| | GO:0000049 | 0.0032761 | 0.999218 | 9 | 30 | tRNA binding | MF | 0.031887682 |
| | GO:0048038 | 0.0038197 | 0.9995601 | 5 | 11 | quinone binding | MF | 0.034855201 |
| | | | | | | | | |
| **AbCip:** | | | | | | | | |
| | GO:0005887 | 4.48E-07 | 0.9999999 | 27 | 99 | integral component of plasma membrane | CC | 6.64E-05 |
| | GO:0045272 | 4.54E-05 | 0.999997 | 7 | 12 | plasma membrane respiratory chain complex I | CC | 0.002664886 |

| | | | | | | | | |
|---|---|---|---|---|---|---|---|---|
| | GO:0008137 | 9.00E-05 | 0.9999929 | 7 | 13 | **NADH dehydrogenase (ubiquinone) activity** | MF | 0.002664886 |
| | GO:0009060 | 9.00E-05 | 0.9999929 | 7 | 13 | **aerobic respiration** | BP | 0.002664886 |
| | GO:0009432 | 9.00E-05 | 0.9999929 | 7 | 13 | SOS response | BP | 0.002664886 |
| | GO:0099132 | 0.0015503 | 0.999864 | 5 | 10 | ATP hydrolysis coupled cation transmembrane transport | BP | 0.038240038 |
| | | | | | | | | |
| **AbGent:** | | | | | | | | |
| | GO:0045272 | 6.71E-08 | 1 | 12 | 12 | plasma membrane respiratory chain complex I | CC | 9.93E-06 |
| | GO:0008137 | 1.24E-05 | 0.9999993 | 11 | 13 | NADH dehydrogenase (ubiquinone) activity | MF | 0.000685478 |

| | | | | | | | | |
|---|---|---|---|---|---|---|---|---|
| | GO:0051082 | 1.39E-05 | 0.999999 | 12 | 15 | unfolded protein binding | MF | 0.000685478 |
| | GO:0005829 | 8.20E-05 | 0.999951 | 118 | 348 | cytosol | CC | 0.003034026 |
| | GO:0048038 | 0.0001397 | 0.999991 | 9 | 11 | quinone binding | MF | 0.003461981 |
| | GO:0009060 | 0.0001404 | 0.9999876 | 10 | 13 | **aerobic respiration** | BP | 0.003461981 |
| | GO:0051537 | 0.0006792 | 0.9998184 | 17 | 32 | 2 iron, 2 sulfur cluster binding | MF | 0.014360095 |
| | GO:0005524 | 0.0011434 | 0.9993209 | 76 | 221 | **ATP binding** | MF | 0.021153405 |
| | GO:0006099 | 0.0018825 | 0.9995827 | 12 | 21 | tricarboxylic acid cycle | BP | 0.030956723 |
| | GO:0051301 | 0.0027479 | 0.9992393 | 14 | 27 | cell division | BP | 0.040669255 |
| | GO:0016226 | 0.0038105 | 0.999543 | 7 | 10 | iron-sulfur cluster assembly | BP | 0.046996546 |
| | GO:0099132 | 0.0038105 | 0.999543 | 7 | 10 | ATP hydrolysis coupled cation transmembrane transport | BP | 0.046996546 |
| | | | | | | | | |
| **PaCip:** | | | | | | | | |
| | GO:0005829 | 1.5411E-10 | 1 | 88 | 596 | cytosol | CC | 4.6387E-08 |

| | | | | | | | | |
|---|---|---|---|---|---|---|---|---|
| | GO:0005515 | 1.6401E-05 | 0.99999256 | 49 | 349 | protein binding | MF | 0.00246842 |
| | GO:0016226 | 3.2454E-05 | 0.9999985 | 6 | 10 | iron-sulfur cluster assembly | BP | 0.00325621 |
| | GO:0005737 | 0.00011236 | 0.99994478 | 48 | 365 | cytoplasm | CC | 0.00845502 |
| | GO:0001896 | 0.00021704 | 0.99998253 | 6 | 13 | autolysis | BP | 0.01306574 |
| | GO:0009432 | 0.00094306 | 0.99985892 | 7 | 22 | SOS response | BP | 0.04355305 |
| | GO:0000049 | 0.00101286 | 0.99979112 | 9 | 35 | tRNA binding | MF | 0.04355305 |
| | | | | | | | | |
| **SaLevo:** | | | | | | | | |
| | GO:0009432 | 3.67E-05 | 0.9999973 | 7 | 15 | SOS response | BP | 0.00433248 |
| | GO:0006096 | 1.51E-04 | 0.99998479 | 7 | 18 | glycolytic process | BP | 0.00888559 |

TABLE 9 displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_mero GeneID = NC_ 009648 | KPN_00050 | 1178-1277 | AGATCGTGCTTACCGCATGCTGATGAACCGCAAATTCTCTGAAGAAGCGG CAACCTGGATGCAGGAACAGCGCGCCAGTGCGTATGTTAAAATTCTGAGC | SEQ ID NO: 140 | C | | x |
| Kp_mero | KPN_00098 | 523-622 | GGAACGTTGTGGTCTGAAAGTTGACCAACTTATTTTCGCCGGGTTAGCGG CCAGTTATTCGGTATTAACAGAAGACGAACGTGAGCTGGGCGTCTGCGTT | SEQ ID NO: 141 | C | | x |
| Kp_mero | KPN_00100 | 635-734 | TCGATTGTGCCATCGTTGTTGACGATTATCGCGTACTGAACGAAGACGGT CTGCGCTTTGAAGACGAATTTGTTCGCCACAAAATGCTGGATGCGATCGG | SEQ ID NO: 142 | C | | x |
| Kp_mero | KPN_00945 | 637-736 | AGTGCTGTGGTATGGCGAGAAAATCCATGTCGCCGTGGCGGCCGAAGTGC CCGGCACCGGCGTGGATACCCCGGAAGATCTGGAGCGCGTCCGCGCTGAG | SEQ ID NO: 143 | C | | |
| Kp_mero | KPN_00949 | 157-256 | GTGGATGCGTTCCGCCACGTCAGTGATGCGTTTGAGCAGACCAGCGAAAC CATCAGCCAGCGCGCCAATAACGCGATCAACGATTTGGTGCGCCAGCGTC | SEQ ID NO: 144 | C | | |
| Kp_mero | KPN_00950 | 61-160 | GTTAAGCTGGCGCAGGCGTTGGCCAATCCGTTATTTCCGGCGCTGGACAG CGCCCTGCGCGCGGGCCGTCATATCGGTCTCGACGAGCTGGATAATCACG | SEQ ID NO: 145 | C | | |
| Kp_mero | KPN_01276 | 1-100 | ATGCTGGAGTTGTTGTTTCTGCTTTTACCCGTTGCCGCCGCTTACGGCTG GTACATGGGGCGCAGAAGTGCACAACAGTCCAAACAGGACGATGCGAGCC | SEQ ID NO: 146 | C | | x |
| Kp_mero | KPN_02357 | 679-778 | TGATCAAATGTGCGCTGGTCGCCGGGATGGTGGTAATTGCGTTAGTGAAC AGGTATGTTCTGGTACCGCGCATGTCGGCAAGCGGTTCGCAGGCGGAAAG | SEQ ID NO: 147 | C | | |
| Kp_mero | KPN_02805 | 81-180 | GTTAATGATTGAACGCCTGCGTGCGATCGGCTTTACCGTTGAACCGATGG ATTTCGGCGATACGCAGAATTTCTGGGCCTGGCGCGGCCACGGCGAGACG | SEQ ID NO: 148 | C | | |
| Kp_mero | KPN_02846 | 732-831 | GCGCAGGATCTGGTGATGAACTTTTCCGCCGACTGCTGGCTGGAAGTGAG CGATGCCACCGGTAAAAAACTGTTCAGCGGCCTGCAGCGTAAAGGCGGTA | SEQ ID NO: 149 | C | | x |
| Kp_mero | KPN_02864 | 527-626 | CCGTACCCGCTGGTGGACGATCTGGAGCGATTCTACGACCATCTTGAGCA GACGCTGCTGGCGACGGGCTTTATCCGCCCGAATCATCCGGGGCAGGTGA | SEQ ID NO: 150 | C | | |
| Kp_mero | KPN_03230 | 100-199 | ATCCGCAAAAGCGAAAAAGATACGCGTCAGTATCAGGCGATCCGCCTTGA TAACGACATGGTCGTGCTGCTGGTTTCCGATCCGCAGGCGGTGAAATCGC | SEQ ID NO: 151 | C | | |
| Kp_mero | KPN_03317 | 34-133 | ATGGCCGGGGAACACGTCATTTTGCTGGATGAGCAGGATCAGCCTGCCGG TATGCTGGAGAAGTATGCCGCCCATACGTTTGATACCCCTTTACATCTCG | SEQ ID NO: 152 | C | | x |
| Kp_mero | KPN_03628 | 256-355 | CCGCCGTTAATGCCGGTTTATCCGGTGGCGCGTGGTGAAAGCCGCCTGTA TATGCAACGTATCGAGAAGGACTGGTATTCGCTGATGAACACCATCCAGA | SEQ ID NO: 153 | C | | |
| Kp_mero | KPN_03634 | 656-755 | AGCAATGACGGCGAAACGCCGGAAGGCATTGGCTTTGCGATCCCGTTCCA GTTAGCGACCAAAATTATGGATAAACTGATCCGCGATGGCCGGGTGATCC | SEQ ID NO: 154 | C | | x |
| Kp_mero | KPN_04331 | 423-522 | TCTGAAGGAGAATGGCAAAGAGGTGGTGATCAAGGTTATCCGCCCGGATA TTTTGCCGATCATTAAAGCGGACATGAAGCTCATCTACCGCCTGGCGCGC | SEQ ID NO: 155 | C | | |
| Kp_mero | KPN_04429 | 49-148 | CAGGTGCTGGTAAAAAGCAAGTCTATTCCGGCAGAGCCTGCCCAGGAATT AGGACTCGATACCTCGCGTCCGGTCATGTACGTCCTGCCCTATAATTCGA | SEQ ID NO: 156 | C | | |
| Kp_mero | KPN_04616 | 1272-1371 | TCATCGTGATGCAGGCCCAGGACGTCTGGATCCGTACCCTCTATGACCGC CACCGCTTTGTGGTGCGCGGCAACCTTGGCTGGATCGAAGCGGACAACTT | SEQ ID NO: 157 | C | | |
| Kp_mero | KPN_04617 | 3455-3554 | CGATAGCGCCGCGATGACCTCAATGCTTATTGGTATGGGGGTTGCACAAA GTGGTCAGGTTGTGGGTAAAATCGGCGAGACGTTTGGCGTAAGCAACTTG | SEQ ID NO: 158 | C | | |
| Kp_mero | KPN_04663 | 1199-1298 | ATTCAGTTCGTGCCGAAGCAGTACGAAAATATGTACTTCTCCTGGATGCG CGATATTCAGGACTGGTGTATCTCCCGTCAGCTGTGGTGGGGTCACCGCA | SEQ ID NO: 159 | C | | |
| Kp_mero | KPN_04666 | 450-549 | CAGGCCAGCGATGGTAACGCGGTGATGTTTATCGAAAGCGTCAACGGCAA CCGCTTCCATGACGTCTTCCTTGCCCAGCTGCGTCCGAAAGGCAATGCGC | SEQ ID NO: 160 | C | | x |
| Kp_mero | KPN_00055 | 496-595 | CCCGATGCTGTGCGGCGAAGTGGTCGGCATGCTGGTGGGCATCGGCGTCG GCACGCTGCTGGGCATGGAGCCGTTCCAGGTGTTCTTCTTTATCGTGCTG | SEQ ID NO: 161 | R | dn | |
| Kp_mero | KPN_00499 | 331-430 | TCTTCCCAATTTTAAATAACCCGGTGCCAGCAGGTATTGCCTGTATTGCC ATCGTGTGGATCTTTACTTTCGTTAATATGCTCGGCGGGACCTGGGTCAG | SEQ ID NO: 162 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_mero | KPN_00681 | 452-551 | CTTCTCCGATACCATCTTCGTGGTCGGTACCCGTCTGCTGGTGAAGAAAGGCGGTCCGATCAAAGATTTCCCGGACCTGAAGGATAAAGCGGTCGTCGTC | SEQ ID NO: 163 | R | dn | |
| Kp_mero | KPN_00699 | 295-394 | TCCGGCAGAAAATATCAACCTGCTGAATGGTAACGCGCCGGACATCGATGCGGAATGCCGTCGCTATGAAGAAAAAATTCGTTCCTACGGTAAAATCCAC | SEQ ID NO: 164 | R | dn | |
| Kp_mero | KPN_00840 | 385-484 | GACATCAAAGATGTCAAAGATCTGAACGGTAAAGTGGTCGCGGTGAAGAGCGGCACCGGCTCCGTTGACTACGCGAAAGCCAATATCAAAACCAAAGATC | SEQ ID NO: 165 | R | dn | |
| Kp_mero | KPN_00868 | 110-209 | TGCAACTGCGAAAGGCCAAAGGCTACATGTCAGTCAGCGAAAATGACCATCTGCGTGATAACTTGTTTGAGCTTTGCCGTGAAATGCGTGCGCAGGCGCC | SEQ ID NO: 166 | R | dn | x |
| Kp_mero | KPN_00956 | 570-669 | CTTCAGCACCGCAGCCACCTACGCGTTCGACAACGGTATCGCACTGTCTGCAGGCTACTCCAGCTCTAACCGTAGCGTCGATCAGAAAGCTGACGGCAAT | SEQ ID NO: 167 | R | dn | |
| Kp_mero | KPN_01105 | 326-425 | AGCGGATTGGTTTTCTGTGCGATATCCGCCAGGCGGTGTTCAATCCAAACCTGTTTCCGCATGAGAACATGGAAGGCAAAATCGACCGACCGGAAGAGTA | SEQ ID NO: 168 | R | dn | |
| Kp_mero | KPN_01164 | 1059-1158 | GGAAGCCTTACAGATTATGGAAGCGGATGTTATAAATGGCGCTCTGGATAGCGATGTCTTCCTCGTTTTGCGCCACCATGCGGAAACGCTACACGCCATC | SEQ ID NO: 169 | R | dn | |
| Kp_mero | KPN_01172 | 834-933 | CTGTGCGGCGTCTACTTCCTCGGCGAACAGCGTATCGACTATGAGGGCGCCAGCTTCGGGGTGGTCACCTGCGATCCGCAGAGTATCGATGTTGAAGCGG | SEQ ID NO: 170 | R | dn | |
| Kp_mero | KPN_01229 | 3-102 | GAACAAAAGCTTAGCAGGAATACTGGGCGTCACCGTCGCGTTAACCTTACTGGCGGGCTGTACCGCTTACGATCGTACCAAAGACCAGTTTACCCAGCCG | SEQ ID NO: 171 | R | dn | |
| Kp_mero | KPN_01529 | 69-168 | AGCGGTGTACCTGCACCAACGGATTGGTGGACGCATCAAAGCCTTTTTGCCGATCTATGATTTTTCCTATGAAATGACCACCCTGCTGTCGCCGGACGAG | SEQ ID NO: 172 | R | dn | |
| Kp_mero | KPN_01553 | 610-709 | AGGCAGATCGTCAATATGCTGACAACCGGACTCGCCATCCGTGACGGTCGGGTGTACAGCAATTTGCGGGTGGACGTGCAGGCTGACAATTCGCACTGGG | SEQ ID NO: 173 | R | dn | |
| Kp_mero | KPN_02241 | 71-170 | GGGTAGGTTACTCCATTCTGAACCAGCTTCCGCAGCTTAACCTGCCACAATTCTTTGCGCATGGCGCAATCCTAAGCATCTTCGTTGGCGCAGTGCTCTG | SEQ ID NO: 174 | R | dn | x |
| Kp_mero | KPN_02411 | 1592-1691 | CGCGATGAATCGCACGATCATGCGATCTCCGGGCATCGCAAAAAACGGGCGAAAGTGAAGAGCACCAGCTCGCTTGAGACTATCGAGGGGGTGGGGCCGA | SEQ ID NO: 175 | R | dn | |
| Kp_mero | KPN_02412 | 177-276 | GTGCCGGGCTAATTCCGCAGATGTCGTCCTGATGGACATGAACATGCCTGGGATCGGTGGTCTTGAAGCGACGCGCAAAATCGCGCGCTCCGTGGCGGGC | SEQ ID NO: 176 | R | dn | |
| Kp_mero | KPN_02563 | 150-249 | TCGCCTGCCGCACAAGCTGCTGTGCTACGTCACCTTCTCCATTTTCTGCATTATGGGGACCTATTTCGGTCTGCATATCGAAGACTCCATCGCCAACACC | SEQ ID NO: 177 | R | dn | |
| Kp_mero | KPN_02725 | 174-273 | GTTAAGCGAAAAAGCCCGCAATGTCGAATCTGAGCCGTGCCAAATTAACCCAACCTTCACTGACGTTGACGGCGGTGTGCAGCTGGATATCGATTTTGTT | SEQ ID NO: 178 | R | dn | |
| Kp_mero | KPN_02907 | 1176-1275 | CGCGCGGTAAATATGTCACCGTGCTGACCAACTGGTGCGGCGAATTTTCCTCGCAGGAAGCGCGACGTTTATTCAGCGATGCCGGCCTCCCTACCTACCG | SEQ ID NO: 179 | R | dn | |
| Kp_mero | KPN_02919 | 100-199 | GTCGCAGACCGTCTCGCCAAACTGGATAAGTGGCAAACTCATTTAATCAACCCGCACATCATTCTGTCTAAGGAGCCGCAGGGTTTTATCGCTGATGCAA | SEQ ID NO: 180 | R | dn | |
| Kp_mero | KPN_03396 | 15-114 | GCAGCTCAAAATACTGTCGTTCCTGCAGTTCTGCCTTTGGGGGAGCTGGCTCACCACGCTTGGCTCGTACATGTTTGTCACGCTGAAGTTTGACGGCGCG | SEQ ID NO: 181 | R | dn | |
| Kp_mero | KPN_04155 | 512-611 | GATCCCGACGCCGGTATGGATCATGGCGATTGTCTTCCTGGCGGCCTGGTACATGCTGCACCATACTCGCCTGGGCCGTTATATTTATGCCCTGGGCGGT | SEQ ID NO: 182 | R | dn | |
| Kp_mero | KPN_04160 | 539-638 | TCATTCGGTCTACCACACCTACTTCACGTCGATTACGCAAAATGAAGTGGTGAAGCTCGATCTCCACCAGGCGATTGTCGATGCCATTCTTAACAGTGAT | SEQ ID NO: 183 | R | dn | |
| Kp_mero | KPN_04423 | 109-208 | ATTAACGGCGACAAAGGCTACAACGGCCTCGCTGAAGTGGGTAAAAAGTTTGAAAAAGACACCGGCATTAAAGTTTCCGTAGAACACCCGGACAAGCTGG | SEQ ID NO: 184 | R | dn | |
| Kp_mero | KPN_04425 | 402-501 | TCATGACGTTCACATGATCGACTTCTACTACTGGGATATCTCCGGCCCGGGTGCAGGTCTGGAAAACGTTGACCTTGGCTTCGGTAAGCTCTCTCTGGCC | SEQ ID NO: 185 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_mero | KPN_04553 | 452-551 | CGCTTTGACGAACATTTCGTCCTTGACCTGCTGGTCGATGACGGGCAGGC CCGCGGCCTGGTGGCGATGAATATGATGGAAGGCACCCTGGTGCAGATCC | SEQ ID NO: 186 | R | dn | |
| Kp_mero | KPN_04582 | 56-155 | GCGCCCTGCAGGGAACGCCGGAAGCCCCGCCGCCCGCCACCGACCATCCG CAGGAGATCCAGCGCTACCAGACGGCTGGCCTGCAGAAAATGGCCACGGT | SEQ ID NO: 187 | R | dn | |
| Kp_mero | KPN_04672 | 183-282 | TTTTGCCAACGCCTTCGGCTTCAGCGGCTTTAACGAAATGAAACAGATGT TCAAGCAACATTTGATGGAAGAGACCGCCAACTATACCGAGCGCGCCCGT | SEQ ID NO: 188 | R | dn | |
| Kp_mero | KPN_04814 | 230-329 | CGCAAAAATGTCGATCGCGGCATTAATATGCATGTGGTGACGGAAGTGCA GCACATTGTGATCCTCGCCGAGCATAAGCTGCTGGACTATCGCGACGTCG | SEQ ID NO: 189 | R | dn | |
| Kp_mero | KPN_00016 | 501-600 | TGAAGATTTTCCTGATGGCGCTGGCGATTATTGATGACCTCGGGGCTATC GTGATTATCGCGCTGTTTTATACCCACGACCTGTCCATGCTCTCGCTGGG | SEQ ID NO: 190 | R | up | |
| Kp_mero | KPN_00017 | 403-502 | TGGAGCAGCTGAGCCAGCATAAGCTCGACATGATTATCTCTGACTGCCCG ATCGACTCGACGCAGCAGGAAGGGCTATTTTCGGTGAAGATCGGCGAGTG | SEQ ID NO: 191 | R | up | |
| Kp_mero | KPN_00043 | 139-238 | GCCGCCGAGCAGGCGGCGCTGGCCCGTGCCGATCTGGTTATCTGGCAGCA TCCTATGCAGTGGTATAGCGTACCGCCGCTGCTCAAGCTGTGGATGGACA | SEQ ID NO: 192 | R | up | |
| Kp_mero | KPN_00078 | 682-781 | AAAGCGGGCCTGGTCGCGCCGGACGAAACCACCTTCAATTACGTACGCGG CCGTCTGCATGCGCCGAAAGGCAAAGATTTTGACGATGCCGTAGCGTACT | SEQ ID NO: 193 | R | up | |
| Kp_mero | KPN_00164 | 208-307 | GCTGTGGCTGCTGGTCAAGCTGGGGATTGTCTTCGCGGTGCTGATTGCCG CCTATGGCGTCTACCTCGACCAGAAAATCCGCAGCCGCATTGACGGTAAA | SEQ ID NO: 194 | R | up | |
| Kp_mero | KPN_00176 | 597-696 | GCAACCCGTTCGGTCTGGGCGAAACCGTGACCTCCGGGATTGTCTCCGCG CTGGGCCGTAGCGGCCTCAACGTGGAAAACTACGAAAACTTTATCCAGAC | SEQ ID NO: 195 | R | up | |
| Kp_mero | KPN 00200 | 1-100 | ATGCTGGGTTTGAAACGGGTTCACCATATTGCCATCATTGCGACCGACTA CGCCCGCAGTAAAGCGTTCTATTGCGATATTCTGGGGTTTACGCTGCAAA | SEQ ID NO: 196 | R | up | |
| Kp_mero | KPN_00320 | 351-450 | CATTCCGCCGTTTCTGGTCCATACCGCGCTGAAGATCACCTCGCCAAACG GTAAAAGCTATAGCGACCGTCTGGACAATGTGAAGACGGAAAAGCAGTTG | SEQ ID NO: 197 | R | up | |
| Kp_mero | KPN_00331 | 478-577 | GCGTGGTGCTGGGCAATATGCTGACCAATATGTTCAGCGGCTCGCACCCG CAGGAGATAGTCAATATCATCGAAGAGAAGCCGCAGCCTGATGCCGCCTC | SEQ ID NO: 198 | R | up | |
| Kp_mero | KPN_00341 | 205-304 | CGCGGCAGTTGGGAGCCGCTGCTGTATGGTCTGCACCAGATGCAGATGCG TAATAAAAAGCGTCGGCGCGAGCTGGGAAGCCTGATTAAACGCTTTCGCA | SEQ ID NO: 199 | R | up | |
| Kp_mero | KPN_00560 | 917-1016 | GTGCTGAAGCCGGACCACACCGCCGGGCAGCGTCGTCTGACCCTCGCGGG GCAGCAGGGGCAGCAGTTTGCGGTCGAGAAAGGGCTGCAGGCGGGCGAGC | SEQ ID NO: 200 | R | up | |
| Kp_mero | KPN_00833 | 134-233 | AACCACTTTAGATGGTCTGGAAGCAAAACTGGCTGCTAAAGCCGAAGCCG CTGGCGCGACCGGCTACAGCATTACTTCCGCTAACACCAACAACAAACTG | SEQ ID NO: 201 | R | up | x |
| Kp_mero | KPN_01006 | 184-283 | CTGATGTTCCTGACCTACAAAACGGCGAATAAACCCACCGGGATTATTTC CGCCTTCGCCTTCACCGGGTTCCTCGGCTATATCCTTGGGCCGATGCTGA | SEQ ID NO: 202 | R | up | |
| Kp_mero | KPN_01107 | 100-199 | GCTGTCGCTGGTCTCAACGTGTTGGATCGCGGCCCGCAGTATGCGCAAGT GGTCTCCAGTACACCGATTAAAGAAACCGTGAAAACGCCGCGTCAGGAAT | SEQ ID NO: 203 | R | up | x |
| Kp_mero | KPN_01111 | 722-821 | GATCAAGGCGTCGGTTGAGCCGGATGGCCGCCGTCTGGTTGAGGTCCATC AGCCGCTGTCTGAGCATATCGATGACGACCCGCAGACCCTGCCCATTACG | SEQ ID NO: 204 | R | up | |
| Kp_mero | KPN_01183 | 88-187 | GCTCAGGACTATGTTGAGAAGCGAATCGACCTCAACGAGCTGCTGGTGCA GCATCCCAGCGCGACCTATTTTGTCAAAGCCGCTGGCGACAGCATGATCG | SEQ ID NO: 205 | R | up | |
| Kp_mero | KPN_01184 | 273-372 | CCCGCGCTGCGAAATTTACAGTATCGATGAGGCCTTTTGCGATGTCAGCG GTGTGCGTCATTGCAGAGATCTGACCGATTTTGGCCGCGAAATCCGCGCC | SEQ ID NO: 206 | R | up | |
| Kp_mero | KPN_01226 | 253-352 | GCGCGATGCACGATCTGATCGCCAGCGACACCTTCGATAAGGCGAAGGCG GAAGCGCAGATCGATAAGATGGAAGCGCAGCATAAAGCGATGGCGCTGTC | SEQ ID NO: 207 | R | up | x |
| Kp_mero | KPN_01266 | 19-118 | CGCGAACGCCAGCAGCGGCTGAAAGATAAAGTTGACGCCCGGGTGGCGGC GGCCCAGGACGAGCGCGGCATTGTGATGGTCTTTACCGGCAACGGCAAAG | SEQ ID NO: 208 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Kp_mero | KPN_01448 | 49-148 | TCCGGCTGTGTCTATAACAGTAAGGTGTCCACCGGTGCGGAACAGCTGCA GCATCATCGCTTCGTGCTGACCAGCGTCAACGGCCAGGCGGTCAACGCCA | SEQ ID NO: 209 | R | up | |
| Kp_mero | KPN_01624 | 130-229 | CAACGTATGTTTAAGAAAGAGACCGGCCATTCCCTCGGCCAGTACATCCG CAGCCGCAAGCTGACGGAGATTGCGCAGAAGCTCAAGCAGAGCAATGAGC | SEQ ID NO: 210 | R | up | |
| Kp_mero | KPN_01625 | 65-164 | ACCAGAAAAAAGATCGCCTGCTCAATGACTACCTCTCACCTATGGATATT ACCGCGACCCAGTTTCGCGTGCTCTGCTCCATTCGTTGCGAAGTATGTAT | SEQ ID NO: 211 | R | up | |
| Kp_mero | KPN_02024 | 277-376 | CACGGGCGCGCTCCCTTGCCGTGAACTACGGTCTGGTCGGCTATCAGGCG CTGCCGCCGGGTATCGCCAAAAATGTCGCCCGCGGCAAACCGCTCCCTCC | SEQ ID NO: 212 | R | up | |
| Kp_mero | KPN_02342 | 67-166 | TATGGGGTGTTATTCCACAGTGAGGAAAACGTCGGCGGTCTGGGTCTTAA GTGCCAATACCTCACCGCCCGCGGAGTCAGCACCGCACTTTATGTTCATT | SEQ ID NO: 213 | R | up | x |
| Kp_mero | KPN_02345 | 4-103 | ATGCGAATCGCGCTTTTCCTGCTGACGAACCTGGCAGTGATGGTCGTGTT CGGGCTGGTGTTAAGCCTCACGGGGATCCAATCCAGCAGCATGACCGGTC | SEQ ID NO: 214 | R | up | x |
| Kp_mero | KPN_02394 | 556-655 | CGGATTATTACTAAACAAAACCACCTTTGGCCGTAATACGCTGGCTATTG GCGGCAATGAAGAGGCGGCGCGCCTGGCCGGCGTCCCGGTGGTGCGCACC | SEQ ID NO: 215 | R | up | |
| Kp_mero | KPN_02742 | 97-196 | CAAATAGGCGATCGTGACAATTACGGTAACTACTGGGACGGTGGCAGCTG GCGCGACCGTGATTACTGGCGTCGTCACTATGAATGGCGTGATAACCGTT | SEQ ID NO: 216 | R | up | x |
| Kp_mero | KPN_02800 | 75-174 | GCAGCGCTTCAACGACTGGCTGGTCACCTGTAACAACCAAAATTTCTGCG TCACCCGTAACGTGGGGCTGCATCATGGCCTGGTGATGACCCTCAGCCGC | SEQ ID NO: 217 | R | up | |
| Kp_mero | KPN_02938 | 121-220 | GCGCTGGGGCTGTGCCTCGGCGGCAGAGCGGAAGCCGACATGGTGCGTCG CGGCGCCACCCGTGCCGACCTGTGCGCGCGCTTCGCGCTGAAAGATACCC | SEQ ID NO: 218 | R | up | |
| Kp_mero | KPN_03000 | 89-188 | GCCGCGGCGATAATTATGTTTATGTGAACCGCGAAGCGCGCATGGGGCGA ACAGCGTTAGTTATTCATCCN | SEQ ID NO: 219 | R | up | |
| Kp_mero | KPN_03270 | 1-100 | ATGCAACAGACCCCACATCAGCGCAAGACGCTCACCGAACGCGTTATCCA CGCCATCACCTTCGAAGGACTGGCGACGCTGATCCTCGCCCCTACCGCCG | SEQ ID NO: 220 | R | up | |
| Kp_mero | KPN_03358 | 539-638 | GGGCGAAAAACTGGTGAACTCGCAGTTCTCCCAGCGTCAGGAATCGGAAG CGGATGACTACTCTTACGACCTGCTGCGTAAGCGCGGTATCAATCCGTCG | SEQ ID NO: 221 | R | up | x |
| Kp_mero | KPN_03458 | 362-461 | CCGCGGGCCAGTTGCTGAACATTTATTACGAAACCGCCGATAACTGGCTG CGTCGTCACGATATGGGGCTGCGCATCCGCGGCGATCAGGGGCGTTATGA | SEQ ID NO: 222 | R | up | |
| Kp_mero | KPN_03844 | 749-848 | CATGGCGGCGGAAGAAGAAATTCAGTTTTGCCCACTGAGCCAGCTGCTGC CCGCTGACTTTAGCGAGCTGCCCTCAGGCAAAGTGGTTCGTGGTGAACTG | SEQ ID NO: 223 | R | up | |
| Kp_mero | KPN_03846 | 100-199 | TGCGCCACCCTGGGGCGGCAATATGAAATTCTGTTGATCGACGATGGCAG CAGCGACGATTCCGCGCGCATGCTCACCGAAGCCGCCGAGGCGGAAGGCA | SEQ ID NO: 224 | R | up | |
| Kp_mero | KPN_03847 | 229-328 | GAAGTCATTACGCCGTCCCAGACCTGGGTCTCCACTCTCAATATGATCTG CCTGCTGGGCGCCACGCCGGTGATGATCGATGTCGATAACGACAATCTGA | SEQ ID NO: 225 | R | up | |
| Kp_mero | KPN_03856 | 895-994 | TAAGCGGATCGGCATTGACCCGGCGGTAGTTTCCGCGCCGTTTATCGCCA CGCTGATTGATGGCACCGGGCTAATTATCTATTTCAAAATCGCCCAGTAT | SEQ ID NO: 226 | R | up | |
| Kp_mero | KPN_03903 | 141-240 | GACCAGCCAGTTCCTGCTGGCCTGTAAATACGATGCGCCAGCGACGATCG CAGCCATGCTGGATAACGGCATTGATGTGGATGGTCAGGATAAAACCGGC | SEQ ID NO: 227 | R | up | |
| Kp_mero | KPN_03934 | 257-356 | TGCCTTATATTACCAAGCAGAATCAGGCGATTACTGCGGATCGTAACTGG CTTATTTCCAAGCAGTACGATGCTCGCTGGTCGCCGACTGAGAAGGCGCG | SEQ ID NO: 228 | R | up | x |
| Kp_mero | KPN_03993 | 558-657 | TGGCGGCGGTCTATAACGTCCCGCTGGCCGGGGCGTTGTTCAGCCTTGAG GTCATGCTGCTGTCGTTTAGCTGGGAAAAAACGCTGGCGGCGATAATGAC | SEQ ID NO: 229 | R | up | |
| Kp_mero | KPN_04036 | 1361-1460 | CTCGACTACCTCGACGCCTTCGGCGCGGCGATCCACGCGGCGTTTCTGAT GGCGGCCGGCATTATGGCGGTGGCGTTTGTCCTCTCATGGCTGTTAAAGG | SEQ ID NO: 230 | R | up | |
| Kp_mero | KPN_04037 | 309-408 | GATGATGGTCGAGACGCTGGGGCATATGGCGGAGAAAAACGCCTGGTTCG CGCCGCTGTGGATGCAGGAGATCATCGGCGAGATGCCGATTCTGCGCCAG | SEQ ID NO: 231 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_mero | KPN_04077 | 10-109 | ACCGTATTCTGCATTTTGCTGTTCGCCGCCCTGCTGCACGCCAGCTGGAA CGCTATCGTCAAAGCCAGCGGCGATAAAATGTACGCGGCGATCGGCGTCA | SEQ ID NO: 232 | R | up | |
| Kp_mero | KPN_04129 | 387-486 | CGCTGGGCCGCCACACGGTGCAGATGCTGCATGACGTACTGGATGCGTTT GCGCGTATGGATCTCGACGAAGCGGTACGTATCTATCGCGAAGATAAGAA | SEQ ID NO: 233 | R | up | |
| Kp_mero | KPN_04131 | 431-530 | GGTGGCGCAGATGCAGCACTTCTCGGGCTGGGCGGGCGTTATCGCGCTGG CGCTGCTGCAGGTGCCTATCGTTATTCGTACCACCGAAAACATGCTGAAG | SEQ ID NO: 234 | R | up | |
| Kp_mero | KPN_04132 | 48-147 | CATGATTTTCAGTGCGCTGGTAAAACTGGCTGCGCTGATTGTGCTATTGA TGCTGGGCGGCATCATCGTTTCCCTGATCATCTCTTCCTGGCCGAGCATT | SEQ ID NO: 235 | R | up | |
| Kp_mero | KPN_04133 | 160-259 | AATAAAGTGAACTACCAGGGTATTGGTTCCTCTGGTGGCGTTAAGCAGAT TATTGCCAACACCGTTGATTTCGGTGCTTCTGATGCTCCGCTGGCTGATG | SEQ ID NO: 236 | R | up | |
| Kp_mero | KPN_04244 | 253-352 | CCCGGCGGCAAGAGCGTGGAGGAGTATCGCGCCTATTATAAGAAGGGCTA CGCCACCGATGTGGAGCAGATTGGCATTGAAGATGACGTGATTGAGTTCC | SEQ ID NO: 237 | R | up | |
| Kp_cip GeneID = NC_ 016845 | KPHS_08300 (KPN_00111 (nadC)) | 141-240 | GCAATTATTGCCGCAGGATGCACGCTCCCATGCGGTGGTCATTACTCGTG AAGATGGCGTCTTCTGTGGCAAACGCTGGGTGGAAGAGGTCTTTATTCAG | SEQ ID NO: 238 | C | | x |
| Kp_cip | KPHS_08670 (KPN_00140 (panC)) | 82-181 | CCGACGATGGGCAACCTGCATGATGGTCATATGAAGCTGGTTGATGAAGC CAAAGCCAGTGCGGACGTGGTGGTGGTCAGTATTTTCGTCAATCCGATGC | SEQ ID NO: 239 | C | | x |
| Kp_cip | KPHS_15300 (KPN_00697 (nagC)) | 347-446 | CTGCCCGAGCGCACCCAGGAAACGCTGGAACACGCCCTGCTGAATATCAT CGCCACCTTTATCGAAAACTGTCAGCGCAAAATTCGCGAGCTGATCGCTA | SEQ ID NO: 240 | C | | x |
| Kp_cip | KPHS_20110 (KPN_01134 (ycfD)) | 20-119 | TGGATTATCAATTAACGCTTAACTGGCCCGACTTTATCGAACGCTACTGG CAAAAACGGCCGGTGGTATTGAAGCGCGGCTTCGCCAATTTTATCGACCC | SEQ ID NO: 241 | C | | x |
| Kp_cip | KPHS_29220 (KPN_01944 (ydcG)) | 60-159 | TGTTGCCGCCGTATGCGGAACGTCAGGAGTCGCTTCCTTATTCAGTCAGG CCGCTTTTGCCGAAGACGCGGGCATTGCCGACGGGCAAACGCGTCGTTTT | SEQ ID NO: 242 | C | | x |
| Kp_cip | KPHS_33420 (KPN_02329 (yeaB)) | 80-179 | TCAATCAGCGGCAGGCGGCGGTGCTGGTGCCGATCGTGCGCGCCGGCCGCAG CCCGGCCTGCTGCTGACCCAGCGTTCGCCCGCTGCTGCGCAAGCACGCCGG | SEQ ID NO: 243 | C | | x |
| Kp_cip | KPHS_34080 (KPN_02387 (yecM)) | 100-199 | GCGCGACTGGGACTGGAGATCGCCGGGCTCGACGCCGACCATATCTCCCT GCGCTGTCATCAGAATACCACTGCGGAACGCTGGCGCCGCGGTCTGGAGC | SEQ ID NO: 244 | C | | x |
| Kp_cip | KPHS_37030 (KPN_02637 (yojN)) | 2443-2542 | AGATTGTATACTGAAATCGAAGCGGGCGATTTTGCTGCTCTGGCGCAAAC CGCCCACCGCCTCAAAGGGGCATTTGCTATGCTTAATCTGATACCCGGCA | SEQ ID NO: 245 | C | | x |
| Kp_cip | KPHS_42920 (KPN_03229 (recB)) | 350-449 | GAACGGCAGATGGACGAGGCGGCGGTATTCACCATCCACGGCTTTTGCCA ACGGATGCTGAGCCTTAACGCCTTCGAGTCGGGCATGCTGTTCGAGCAAC | SEQ ID NO: 246 | C | | x |
| Kp_cip | KPHS_44560 (KPN_03386 (yggT)) | 143-242 | TCGGACCGCTGCGCCGGATTATCCCGGCAATGGGGCCGATTGACAGCGCC TCGCTGCTGGTGGCATTTATTCTCTGCGTCATCAAAGCGATCGTGCTGTT | SEQ ID NO: 247 | C | | x |
| Kp_cip | KPHS_47740 (KPN_03634 (degS)) | 617-716 | GGCGAGCTGATGGGGATTAACACCCTCTCCTTTGACAAGAGCAATGACGG CGAAACGCCGGAAGGCATTGGCTTTGCGATCCCGTTCCAGTTAGCGACCA | SEQ ID NO: 248 | C | | x |
| Kp_cip | KPHS_01170 | 77-176 | GAATGACCGATGCCGATTTCGGCAAACCGATTATCGCCGTCGTTAACTCC TTTACCCAGTTTGTCCCCGGGCACGTGCACCTGCGCGATCTCGGCAAACT | SEQ ID NO: 249 | R | dn | |
| Kp_cip | KPHS_01380 | 2-101 | TGATCCCATTTAACGCGCCGCCGGTGGTTGGAACCGAGCTTGATTACATG CAGTCTGCGATGAACAGCGGCAAGCTGTGCGGCGACGGCGGCTTTACGCG | SEQ ID NO: 250 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_cip | KPHS_01410 | 1140-1239 | CTGCACAGTTTCTGTTTCGGCGCTATCTTCAACATGATAGTGCTGGCGCG<br>CGAGGGGCTGGATTCGTTCGGCTCCCGCGTGGTGTTTTTCCTCGTGATCT | SEQ ID NO: 251 | R | dn | |
| Kp_cip | KPHS_01420 | 475-574 | CGACAGCGGGGCGAAAATCGTCACCGTCGCGATGGGGTCGCCGCGCCAGG<br>AGATCTTTATGCGCGACTGCCGGCGCCTGTATCCGCACGCGCTGTATATG | SEQ ID NO: 252 | R | dn | |
| Kp_cip | KPHS_01930 | 151-250 | GAAGAGGTTGCCGAGATCTATTTGCCGCTGTCGCGTTTGCTCAACTTCTA<br>TATCAGTTCTAACCTGCGTCGCCAGGCTGTTCTCGAACAATTTCTTGGCA | SEQ ID NO: 253 | R | dn | |
| Kp_cip | KPHS_07120 | 1767-1866 | CAAAAAGGCCAATACCTCTTCGCTGGATTACTATCACCAGCTGCGCCATG<br>CGGCCAGCAGCTCGCGGCGTAAGTTCCTCTATGACACTAACGTTGGCGCG | SEQ ID NO: 254 | R | dn | |
| Kp_cip | KPHS_07560 | 587-686 | CCTTGGGCGCTATCTGACCCGCCCGCTGCTGCGCTTTGTCGCCCGTTCCG<br>GCCTGCGCGAAGTGTTCAGCGCCGTGGCCCTGTTCCTGGTCTTCGGCTTT | SEQ ID NO: 255 | R | dn | |
| Kp_cip | KPHS_13260 | 412-511 | TGGGCAACCAGGCCGACACCTATGTGGAAATGAACCTCGAACATAAACAG<br>ACCCTGGACAACGGGGCGACCACCCGTTTCAAAGTGATGGTGGCCGACGG | SEQ ID NO: 256 | R | dn | |
| Kp_cip | KPHS_15900 | 291-390 | GAGATCGTCATGCGGGTCTATTTTGAAAAACCGCGCACCACCGTCGGCTG<br>GAAAGGGCTCATCAACGATCCCCATATGGATAACAGCTTCCGCATCAACG | SEQ ID NO: 257 | R | dn | |
| Kp_cip | KPHS_18320 | 1319-1418 | GAGTGGCTGGAAACCTTCCAGGCGAAAGAGCAGGAAGCGACGGAGAAAAT<br>GCTGTCGCTGGAACAGAAAATGAGCGTGGCGCAAACCGCGCACAGCCAGT | SEQ ID NO: 258 | R | dn | |
| Kp_cip | KPHS_18370 | 563-662 | GCGACGGCTTCAGCACCGCAGCCACCTACGCGTTCGACAACGGTATCGCA<br>CTGTCTGCAGGCTACTCCAGCTCTAACCGTAGCGTCGATCAGAAAGCTGA | SEQ ID NO: 259 | R | dn | |
| Kp_cip | KPHS_18380 (KPN_00956 (ompF)) | 39-138 | CCTGCTGGTAGCCGGTGCAGCCAACGCTGCAGAAATCTATAACAAAAACG<br>GCAACAAACTGGACTTCTATGGAAAAATGGTCGGCGAGCACGTCTGGACC | SEQ ID NO: 260 | R | dn | |
| Kp_cip | KPHS_18600 | 972-1071 | GGAGTTCCGCGGTATCCGTCTGGGCACCGTCGGCAAAGTGCCGTTCTTTA<br>TTCCGGGGCTGAAGCAGCGTTTGAACGATGACTATCGTATTCCAGTGGAA | SEQ ID NO: 261 | R | dn | |
| Kp_cip | KPHS_19780 | 857-956 | CCGCGCTGACCTCGTTCCTGACCGGTATCACCGAGCCGATCGAGTTCTCG<br>TTCATGTTCGTGGCGCCGATCCTGTACGTTATCCATGCCATTCTGGCGGG | SEQ ID NO: 262 | R | dn | |
| Kp_cip | KPHS_29510 | 1162-1261 | GCTGCAGTCTATCGGTGAACTGATGATTTCCGGCCTCGGCCTGGCGATGG<br>TCGCTCAGCTGGTTCCTCAGCGTCTGATGGGCTTCATCATGGGCAGCTGG | SEQ ID NO: 263 | R | dn | |
| Kp_cip | KPHS_31980 | 181-280 | TACCGTGAAATGCTGATTGCTGACGGTATTGATCCGAATGAACTGCTGAG<br>CACCATGGCTGCCGTTAAAGCCGGTACCAAAACCAAGCGTGCTGCACGTC | SEQ ID NO: 264 | R | dn | |
| Kp_cip | KPHS_37120 | 220-319 | ATCGCCTATGGATTTTCGAAATTCATCATGGGATCGGTCTCTGACCGCTC<br>GAATCCGCGCATTTTCCTGCCGGCTGGCTTGATCCTCGCCGCGCTGGTGA | SEQ ID NO: 265 | R | dn | |
| Kp_cip | KPHS_37330 | 234-333 | TGGTGCTGCTGGCGAGCCTCGCGACCTGTACTTTCGCCTACCCGTGGCTT<br>GAGGGTTACAAGGACAACAAAGAAGAGTTCTACCTGCTGGTGCTGATCGC | SEQ ID NO: 266 | R | dn | |
| Kp_cip | KPHS_49400 | 898-997 | GCTGGAGGAGATCGAACGCCAGGGGCTGTTCCTGCAGCGGATGGATGATT<br>CCGGCGAATGGTTCCGCTATCACCCGCTGTTTGGCAGCTTCCTGCGCCAG | SEQ ID NO: 267 | R | dn | |
| Kp_cip | KPHS_02660 | 110-209 | TCCGTTCCCCAAACGCGGCGGAAGAACACCTGAAAGCGCTGGCGCGTAAA<br>GGCGCGATCGAGATCGTCTCCGGCGCTTCTCGCGGTATTCGCCTGCTGAC | SEQ ID NO: 268 | R | up | |
| Kp_cip | KPHS_02670 | 624-723 | CGCGGAGTACGCCACCCTCATTATTGGCCTGCTGATGGCGAAGCGGGTGC<br>TGACGCTGCGCGGCGTGTCGCTGGCGATGCTGAAAAACGCCTGGCGCGGG | SEQ ID NO: 269 | R | up | |
| Kp_cip | KPHS_02820 (KPN_04445 (uvrA)) | 2299-2398 | CTATAACCGCGAAACGCTGGAGATTAAGTACAAGGGTAAGACCATCCACG<br>AAGTGCTGGATATGACCATTGAAGAGGCGCGTGAATTCTTTGATGCCGTA | SEQ ID NO: 270 | R | up | x |
| Kp_cip | KPHS_02830 (KPN_04446 (ssb)) | 114-213 | CGAATCCTGGCGTGACAAGCAGACCGGCGAAATGAAAGAGCAGACCGAGT<br>GGCACCGCGTTGTGCTGTTCGGCAAACTGGCGGAAGTCGCTGGTGAGTAT | SEQ ID NO: 271 | R | up | x |
| Kp_cip | KPHS_03430 | 325-424 | TGTCGGTGCTGCGCCCCGCCAGCGCCCATGTCGCCGAGGCCTTTGGCATC<br>AATGAGGGCGAGAACGTGATCCACCTGCGTACCCTGCGCCGGGTCAATGG | SEQ ID NO: 272 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_cip | KPHS_03440 | 498-597 | ATTGAGATGGCCTGGCAGGAAACCTTCTGGGCCCACGGCTTCGGCAAAGT CGTCGACCGCTTTGGCGTCCCCTGGATGATCAACGTGGTCAAACAAGGCT | SEQ ID NO: 273 | R | up | |
| Kp_cip | KPHS_03450 (KPN_04502 (phnA)) | 145-244 | AGCGACATTCTGATCGTTAAAGATGCCAATGGCAATTTACTGGCCGATGG CGACAGCGTTACCGTCGTGAAAGATCTGAAGGTTAAAGGCAGCTCTTCGA | SEQ ID NO: 274 | R | up | x |
| Kp_cip | KPHS_04910 | 1699-1798 | ACCGACAAAGGTTACTACACCAACAGCTTCCACCTCGACGTGGAGAAGAA GGTCAACCCGTACGACAAGATCGATTTCGAAGCGCCGTACCCGCCGCTGG | SEQ ID NO: 275 | R | up | |
| Kp_cip | KPHS_07720 | 2271-2370 | CCAGCAGTCGCCGCTCGATTACGATCACTATTTAACAAAGCAGTTGCAGC CGGTGGCGGAAGGGATCCTGCCCTTCGTCAACGATGACTTTGCTACAATA | SEQ ID NO: 276 | R | up | |
| Kp_cip | KPHS_07860 | 913-1012 | TGTTGAAGCGAACCGGCTCCGTCAACATCAGTCGAAAGTTACCAATAATT TCCGGTTTATTGCTGTCCAGCTGTATTATCGCGGCGAATTGGGTAAGCGC | SEQ ID NO: 277 | R | up | |
| Kp_cip | KPHS_09730 | 671-770 | AGCGCTTCGGTAAATTCGGGCGTATTCTGTGGGAGCGCAGCCACGGGATT GATGAGCGGGAAATTCATAACGATCGGCAGCGTAAATCGGTGGGCGTGGA | SEQ ID NO: 278 | R | up | |
| Kp_cip | KPHS_10170 | 341-440 | CTTGGCGCCCTGTACGACGTGGAAGCCTGGACCGATATGTTCCCGGAATT CGGCGGCGATTCCTCTGCCCAGACCGATAACTTTATGACCAAGCGCGCCA | SEQ ID NO: 279 | R | up | |
| Kp_cip | KPHS_10780 | 308-407 | TCACCAAGCCTTTCTCTCCGAAAGAGCTGGTGGCGCGAATCAAAGCGGTG ATGCGCCGTATTTCACCGATGGCGGTGGAAGAGGTGATCGAAATGCAGGG | SEQ ID NO: 280 | R | up | |
| Kp_cip | KPHS_16320 | 1399-1498 | GAGCACGGCGAGCGCGTGCGCTATCTGCACTCGGATATCGACACCGTCGA GCGCATGGAAATCATCCGCGACCTGCGTCTTGGCGAGTTTGACGTGCTGG | SEQ ID NO: 281 | R | up | |
| Kp_cip | KPHS_16630 | 125-224 | GCAAGGCGCAACCACTTTAGATGGTCTGGAAGCAAAACTGGCTGCTAAAG CCGAAGCCGCTGGCGCGACCGGCTACAGCATTACTTCCGCTAACACCAAC | SEQ ID NO: 282 | R | up | |
| Kp_cip | KPHS_19930 | 157-256 | CAGCTGGCGCAGAAAGCGGATGAGATGGGCGCCACTTCATACCGTATTAC TTCGGTAACCGGTCCGAATACCCTTCACGGTACCGCCGTTATCTACAAGT | SEQ ID NO: 283 | R | up | |
| Kp_cip | KPHS_20630 | 80-179 | CCAAACGCATGCAGCGCATTTTCCCGGAGGCGGAAGTGCGGGTGAAGCCG ATGATGACGCTGCCGGCGATCAACACCGACGCCAGCAAGCATGAAAAAGA | SEQ ID NO: 284 | R | up | |
| Kp_cip | KPHS_20650 | 68-167 | AGTGCGGCTTTCCCAGCCCGGCTCAGGACTATGTTGAGAAGCGAATCGAC CTCAACGAGCTGCTGGTGCAGCATCCCAGCGCGACCTATTTTGTCAAAGC | SEQ ID NO: 285 | R | up | |
| Kp_cip | KPHS_20660 | 276-375 | GCGCTGCGAAATTTACAGTATCGATGAGGCCTTTTGCGATGTCAGCGGTG TGCGTCATTGCAGAGATCTGACCGATTTTGGCCGCGAAATCCGCGCCACG | SEQ ID NO: 286 | R | up | |
| Kp_cip | KPHS_21250 | 277-376 | TGCTGGAGGCGCGGTTGATTAAAGAGCAGCAGCCGCTGTTTAACAAGCGG CTACGGCGTAACAAGCAGCTCTGCGCCTGGCTACTTGCGGACGACCGGCC | SEQ ID NO: 287 | R | up | |
| Kp_cip | KPHS_21390 | 187-286 | AGCCCGTGGCGCGGGCCTTTGGCCACCGCGGCTTCACCCACAGCCTGCTG GCCGTCTTTGGCGCGCTGACGCTGTTCTATCTGAAAGTGCCTGACAGCTG | SEQ ID NO: 288 | R | up | |
| Kp_cip | KPHS_27890 | 610-709 | ACCGTCTCCCTCGACGATTTTGACCAGACCGAGCTGGTGATCTCCATCGG CCATAATCCGGGCACCAACCACCCGCGGATGATGGGCACCCTGCATGAGC | SEQ ID NO: 289 | R | up | |
| Kp_cip | KPHS_31130 | 5-104 | TGCGCTCTATCGCCACCGTTTCGATTTCCGGCACCCTGCCTGAGAAGCTG CACGCTATTGCGGCGGCGGGGTATCAGGGGGTGGAAATTTTCGAGAACGA | SEQ ID NO: 290 | R | up | |
| Kp_cip | KPHS_31630 | 182-281 | TGATCGGCGTTGATATTGTGCTGGCGGTCATCTCCTCGATTATTATCGCC ATGATAATGACCTCGACCGGCCTGCCGGAAATGGGCACGATGCTGGCGAA | SEQ ID NO: 291 | R | up | |
| Kp_cip | KPHS_33810 (KPN_02363 (yebG)) | 4-103 | GCGGTTGAAATTAAATATGTGGTGATCCGCGAAGGTGAGGAAAAAATGTC TTTTGCCAGCAAAAAAGAGGCCGACGCTTACGACAAAATGCTCGATCTGG | SEQ ID NO: 292 | R | up | x |
| Kp_cip | KPHS_34140 | 622-721 | TCGTTAATCAACTGCAGGGAATGTCGGTAAAAGTTGGCGCCGGGGAAACT CAGGCGCATTGGCGGTTGGCGGATGCCGCCGCTGTAAGGACGTGGTTGCA | SEQ ID NO: 293 | R | up | |
| Kp_cip | KPHS_37080 (KPN_02642 (nrdA)) | 2010-2109 | AACAACGACGGTTATCTGCAGCTGGTGGGTATCATGCAGAAGTTTATCGA CCAGTCGATCTCTGCCAACACTAACTACGATCCGACGCGCTTCCCGTCCG | SEQ ID NO: 294 | R | up | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Kp_cip | KPHS_37090 (KPN_02643 (nrdB)) | 805-904 | GCTGAACCTGCTGCGCTCCGGCAGCGACGATCCGGAAATGGCGGAAATCG CCGAAGAGTGCAAGCAGGAGTGCTATGACCTGTTCGTGCTGGCGGCGCAG | SEQ ID NO: 295 | R | up | x |
| Kp_cip | KPHS_39770 | 256-355 | CGTTTTGTGAAAGTCAACACCGAAGCGGAACGTGAGCTTAGCGCCCGGTT TCGTATCCGCAGCATCCCGACCATTATGATGTTCAAAAATGGCGAAGTGA | SEQ ID NO: 296 | R | up | |
| Kp_cip | KPHS_40560 | 121-220 | GCGCTGGGGCTGTGCCTCGGCGGCAGAGCGGAAGCCGACATGGTGCGTCG CGGCGCCACCCGTGCCGACCTGTGCGCGCGCTTCGCGCTGAAAGATACCC | SEQ ID NO: 297 | R | up | |
| Kp_cip | KPHS_40580 | 62-161 | CCACTCTGGAACGAGTGGTTTACCGTCCTGACATCAACCAGGGTAACTAT CTGGCACCAAACGATGTAGCAAAAATTCGTGTCGGTATGACGCAACAGCA | SEQ ID NO: 298 | R | up | |
| Kp_cip | KPHS_41010 (KPN_03030 (recX)) | 380-479 | ACAGCGTAAATACGGCGAACCGTTACCTTCCGCCTTTACTGAAAAAGTGA AAGTTCAGCGATTCCTGCTTTACCGCGGCTACCTGATGGAAGATATCCAG | SEQ ID NO: 299 | R | up | x |
| Kp_cip | KPHS_41020 (KPN_03031 (recA)) | 539-638 | CGGGTAACCTGAAGCAGTCCAACACGCTGCTGATCTTTATCAACCAGATC CGTATGAAAATTGGCGTGATGTTCGGTAACCCGGAAACCACTACCGGTGG | SEQ ID NO: 300 | R | up | x |
| Kp_cip | KPHS_52230 | 272-371 | TGCTGCAGGCGGCGGAAGCGCTCAATTACCGGCCAAACATGATAGCCCAG TCGTTGCTCAGCCAGTCCACCGGCTGCATCGGCGTCATCTGCGCCCAGGA | SEQ ID NO: 301 | R | up | |
| Kp_cip | KPHS_52480 | 80-179 | AAAGCCTTGAACAGCATTTCAATATGCTGCGCCGCCTGGCGGAAAACTGG CAGAGCGGCAAAAACCGCTTTAACGCGCCGGGCGAAACGCTGCTGGGCGC | SEQ ID NO: 302 | R | up | |
| Kp_cip | KPHS_52490 | 10-109 | ACCGTATTCTGCATTTTGCTGTTCGCCGCCCTGCTGCACGCCAGCTGGAA CGCTATCGTCAAAGCCAGCGGCGATAAAATGTACGCGGCGATCGGCGTCA | SEQ ID NO: 303 | R | up | |
| Kp_cip | KPHS_53000 (KPN_04133 (pstS)) | 160-259 | AATAAAGTGAACTACCAGGGTATTGGTTCCTCTGGTGGCGTTAAGCAGAT TATTGCCAACACCGTTGATTTCGGTGCTTCTGATGCTCCGCTGGCTGATG | SEQ ID NO: 304 | R | up | x |
| Kp_gent GeneID = NC_ 012731 | KP1_0027 (KPN_04175 (hemN)) | 189-288 | TTGCCATAAGCTGTGTTATTTCTGCGGCTGCAATAAGATAGTCACCCGCC AGCAGCATAAGGCCGATCAATATCTCGATGTCCTTGAACAGGAGATCATC | SEQ ID NO: 305 | C | | x |
| Kp_gent | KP1_0117 (KPN_04252 (yijC)) | 397-496 | CGGAACTCGCCGACTATTTAGAACTCGAAAACCATATGCCGCGCGCCTTT ACCGAAGCGCAGGCTGAAGCTATGGTCACCATCGTTTTTAGCGCTGGCGC | SEQ ID NO: 306 | C | | x |
| Kp_gent | KP1_0163 | 262-361 | AAGATGTGCCGGTGGAATTCCCGGAGGGCCTGGGGCTGGTGACTATCTGC GAGCGCGACGATCCGCGCGACGCGTTTGTCTCCAATCGCTATGCCTCGAT | SEQ ID NO: 307 | C | | |
| Kp_gent | KP1_0191 (KPN_04329 (ubiE)) | 346-445 | AACGTTGAGTATGTTCAGGCCAACGCGGAAGCCCTGCCTTTTGCTGATAA TACCTTTGACTGCATCACCATCTCTTTCGGTCTGCGTAACGTGACCGACA | SEQ ID NO: 308 | C | | x |
| Kp_gent | KP1_0437 | 161-260 | AGGGTAAACGTCTGGTGGCGCTGGATATCAAGCAGACCGGCGTATTGCAG GGACTACCGCTGCAGTTTAGCGGCAGCAACCTGGTGAAGAGTATTCGCGC | SEQ ID NO: 309 | C | | |
| Kp_gent | KP1_0490 (KPN_04616 (ytfM)) | 1254-1353 | GGGGCTCGGACATCAACTTCATCGTGATGCAGGCCCAGGACGTCTGGATC CGTACCCTCTATGACCGCCACCGCTTTGTGGTGCGCGGCAACCTTGGCTG | SEQ ID NO: 310 | C | | x |
| Kp_gent | KP1_0974 (KPN_00146 (sfsA)) | 370-469 | TACAGGCAGATGACCGACAAAACTGCTATATTGAAGTGAAATCGGTTACG TTGGCGGAGAAAGAATACGGTTATTTTCCCGATGCGGTGACCACGCGCGG | SEQ ID NO: 311 | C | | x |
| Kp_gent | KP1_1702 (KPN_00744 (tolB)) | 1066-1165 | GCACATTGCCAAACAAGATCTGGAAACGGGTGGTGTACAGGTTCTGTCAT CAACGTTTTTAGACGAAACGCCAAGTCTGGCACCTAACGGCACTATGGTA | SEQ ID NO: 312 | C | | x |
| Kp_gent | KP1_1918 | 641-740 | CTGTGGTATGGCGAGAAAATCCATGTCGCCGTGGCGGCCGAAGTGCCCGG CACCGGCGTGGATACCCCGGAAGATCTGGAGCGCGTCCGCGCTGAGCTGC | SEQ ID NO: 313 | C | | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_gent | KP1_4363 | 829-928 | AGATCACCCAGAATCTGGCCGGCGGCACCGACAACACCCTGGCCTCGGTACTCGACTGTACGGTGACGCCGATGGGTAGCCGGATGCTCAAGCGCTGGCT | SEQ ID NO: 314 | C | | |
| Kp_gent | KP1_4377 (KPN_03107 (ygbO)) | 317-416 | CGAGGGCTGCCAGGTACTGGAATATGCTCGCCATAAGCGTAAGCTGCGTTTAGGCGCGCTGAAAGGCAACCAGTTTACCGTGATCCTGCGCGAGATTAGC | SEQ ID NO: 315 | C | | x |
| Kp_gent | KP1_4445 (KPN_03164 (mltA)) | 512-611 | TCGTTGATGGATAACTTCATCATGGACGTGCAGGGCAGCGGCTATATCGACTTTGGCGATGGTTCGCCGCTCAACTTCTTTAGCTATGCCGGGAAAAACG | SEQ ID NO: 316 | C | | x |
| Kp_gent | KP1_0041 | 225-324 | GTCATGGACGGTCATGCGCTTCTCGGAGGTGGAACAAAACGACAAGCTGGAATGGCTCATCCGCAAGGATGGCTGCATGCACTGCGCGGACCCGGGCTGC | SEQ ID NO: 317 | R | dn | |
| Kp_gent | KP1_0276 | 987-1086 | CGACGTGGTGTTGGTAGAAGAGGGAGCCACATTCGCTATCGGTTTGCCGCCAGAACGTTGCCATTTATTCCGTGAGGATGGCACCGCTTGTCGTCGGCTG | SEQ ID NO: 318 | R | dn | |
| Kp_gent | KP1_0395 | 1-100 | ATGTTAAACAACATTCGTATCGAAGAAGATCTGTTGGGCACCAGGGAAGTTCCCGCGGACGCTTACTACGGCGTTCATACTCTGCGAGCGATTGAAAACT | SEQ ID NO: 319 | R | dn | |
| Kp_gent | KP1_0425 | 974-1073 | GAGCGTCTGCCGTTTATCTGTGAACTGGCGAAAGCCTACGTCGGCGTCGATCCGGTGAAAGAGCCGATCCCGGTGCGCCCGACCGCGCACTACACCATGG | SEQ ID NO: 320 | R | dn | |
| Kp_gent | KP1_0908 | 1213-1312 | GAACATTTTAACGATAAAGCCGCCGTGGTGGCTCGCCTGCGCGAGCTGCTGGCGGAGCACAAAATAATGACCATTTTAGTGAAGGGTTCACGTAGTGCCG | SEQ ID NO: 321 | R | dn | |
| Kp_gent | KP1_0909 | 59-158 | CATATCTGACGTTTCGCGCCATCGTCAGCCTGCTGACCGCGCTGTTCATCTCGTTGTGGATGGGCCCGCGCATGATCGCCCGTCTGCAAAAACTCGCCTT | SEQ ID NO: 322 | R | dn | |
| Kp_gent | KP1_0910 | 507-606 | GCAGGCGGTGGCGGCAACCATCCTCAACGTGACTGAGGACCATATGGACCGCTACCCGCTGGGGCTGCAGCAGTATCGCGCGGCGAAGCTGCGGATTTAC | SEQ ID NO: 323 | R | dn | |
| Kp_gent | KP1_1258 | 364-463 | CTGGCCTGCTGGCTGGGGGTGATGGGGTTCGTGGTTTATGTCGGCGTCTACAGCCTGTACATGAAACGCCACTCCGTCTACGGCACGCTGATTGGCTCAC | SEQ ID NO: 324 | R | dn | |
| Kp_gent | KP1_1259 | 127-226 | CATGCGGTTATCCTTGGCACCATTCTGGTGACCGCTGTGGTGCAGATCGTGGTACACCTCGTGTACTTCCTGCATATGAACAGCAAGTCCGATGAAGGTT | SEQ ID NO: 325 | R | dn | |
| Kp_gent | KP1_1260 | 467-566 | CGGTGCTGATGTTCCAGGTTTCACGTCGTGGCCTGACCAGCACTAACCGCACGCGTATCCTGTGCCTGAGCCTGTTCTGGCACTTCCTGGACGTCGTGTG | SEQ ID NO: 326 | R | dn | |
| Kp_gent | KP1_1409 | 690-789 | GGTATCGTCTACATCGCCGCGACTCAGGTTATCGCCGGTATGTATCCTGCTTCTCAGATGGCCGCGTCCGGTGCGCCGTTCGCAATTAGCGCCTCTACCA | SEQ ID NO: 327 | R | dn | |
| Kp_gent | KP1_1410 | 540-639 | GATATCTCCATTTCGGTTTCTGAACTGGGTTCCCTGCTGGACCACAGCGGCCCGCACAAAGAAGCGGAAGAGTATATCGCTCGCGTGTTTAACGCAGAAC | SEQ ID NO: 328 | R | dn | |
| Kp_gent | KP1_1694 | 256-355 | TTCTATGTGGCGATGATTCTGGTGCTGGCCTCGCTGTTCTTCCGTCCGGTCGGTTTTGACTACCGTTCCAAGATCGAGGACACCCGCTGGCGCAACATGT | SEQ ID NO: 329 | R | dn | |
| Kp_gent | KP1_1902 | 764-863 | ATTCAGTGGACCTACTTCGGTTACCTGGCTGCCGTGAAATCTCAGAACGGCGCGGCAATGTCCTTCGGTCGTACCTCCAGCTTCCTGGATATCTACATCG | SEQ ID NO: 330 | R | dn | |
| Kp_gent | KP1_1903 | 473-572 | ATACTTTTGTGGAGGCCGTGAGCCTGGGTATCCTCGCTAACCTGATGGTTTGTCTCGCCGTATGGATGAGCTATTCCGGTCGTAGCCTGATGGATAAAGC | SEQ ID NO: 331 | R | dn | |
| Kp_gent | KP1_3311 (KPN_02199 (adhE)) | 1193-1292 | TTCTCAGGGTGGTATCGGTGACCTGTACAACTTCAAACTCGCGCCTTCCCTGACTCTGGGTTGTGGTTCCTGGGGTGGTAACTCCATCTCTGAAAACGTT | SEQ ID NO: 332 | R | dn | x |
| Kp_gent | KP1_3327 | 1095-1194 | TCCACCTTCCAGATGATCTCCGTGATCTTCCGTAAGCTGACTATGGACCGCGTGAAGGCCCAGGGCGGCAGCGAAGCGCAGGCGATGCGCGAGGCGGCGA | SEQ ID NO: 333 | R | dn | |
| Kp_gent | KP1_3445 | 45-144 | TAATATTGCGAAAGAACGCCTGCAAATCATCGTCGCCGAGCGCCGCCGCGGAGACGCGGAGCCGCATTACCTGCCGCAGTTACGCAAAGATATCCTGGAA | SEQ ID NO: 334 | R | dn | |
| Kp_gent | KP1_3458 | 749-848 | CGTATCGTCGAGGGCGGCGTGAAAATCACCAGCGTCAACATCGGCGGTATGGCGTTCCGCCAGGGTAAAACCCAGGTTAACAACGCGATTTCAGTCGATG | SEQ ID NO: 335 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_gent | KP1_3878 | 66-165 | ATACACCACTTTTTCACAGACGAAAAACGATCAGCTGCTGGAACCCATGT TTTTTGGCCAGCCGGTTAACGTGGCCCGCTACGATCAGCAAAAATACGAC | SEQ ID NO: 336 | R | dn | |
| Kp_gent | KP1_3908 | 32-131 | TGCTACCGCTGCTGATCGTCGGCTTGACGGTGGTGGTTGTGATGCTCTCC ATTGCGTGGCGACGCAATCATTTTCTCAATGCCACGCTGTCGGTTCTTGG | SEQ ID NO: 337 | R | dn | |
| Kp_gent | KP1_3909 | 319-418 | CGTGAAATCGAAAAATACCAGGGCTTCTTCCACCTCAACCTGATGTGGAT CCTGGGCGGCGTTATCGGCGTGTTCCTCGCCATCGACATGTTCCTGTTCT | SEQ ID NO: 338 | R | dn | |
| Kp_gent | KP1_3910 (KPN_02668 (nuoL)) | 1552-1651 | TCCATCGCCAACAGTGCGCCTGGCCGCTTCTTCGGTACCTGGTGGTTCCA TGCCTGGGGCTTCGACTGGTTATACGACAAGGTGTTCGTAAAACCATTCC | SEQ ID NO: 339 | R | dn | x |
| Kp_gent | KP1_3913 | 315-414 | GGTTATCGTTTACGCCATCCTGGGCATTAACGACCAGGGTATCGACGGTG CGGCGATTAACGCCAAAGAAGTGGGCATTGCGCTGTTTGGGCCGTACGTC | SEQ ID NO: 340 | R | dn | |
| Kp_gent | KP1_3914 | 14-113 | TAAAAGAATTATTGGTGGGGTTCGGCACCCAGGTCCGTAGTATCTGGATG ATTGGCCTGCATGCCTTCGCCAAACGTGAAACCCGGATGTATCCGGAAGA | SEQ ID NO: 341 | R | dn | |
| Kp_gent | KP1_3915 | 206-305 | TTAAAGAGGACTGGATCCCGCGCTTCTCCGATCGCGTGATCTTTACTCTG GCGCCGGTTATCGCCTTTACCTCGCTGCTGCTGGCCTTCGCTATCGTGCC | SEQ ID NO: 342 | R | dn | |
| Kp_gent | KP1_3916 | 366-465 | CATAGCTTCCGCCGCTATCGTTTCACCAAGCGTACCCACCGCAATCAGGA TCTGGGGCCGTTTATTTCGCACGAAATGAACCGCTGCATCGCCTGCTACC | SEQ ID NO: 343 | R | dn | |
| Kp_gent | KP1_3917 | 687-786 | CCAACGGCGTCGAGTGGTACCAGAACATTTCCACCAGCAAAGATGCTGGC ACCAAGCTGATGGGCTTCTCCGGCCGGGTGAAGAATCCGGGCGTCTGGGA | SEQ ID NO: 344 | R | dn | |
| Kp_gent | KP1_3919 (KPN_02675 (nuoE)) | 379-478 | ACCCTGCTGCCGACCTGCTGCCTGGGTAACTGCGACAAGGGACCGACCAT GATGATTGATGAGGATACTCACAGCCATCTGACGCCGGAGGCAATTCCTG | SEQ ID NO: 345 | R | dn | x |
| Kp_gent | KP1_4642 | 714-813 | CCGACCATCCTGCGCGACTCTCAGGAATATGTTTCCAAGAAACACAACCT GCCGCACAACAGCCTGAACTTCGTGTTCCACGGCGGTTCCGGTTCTTCCG | SEQ ID NO: 346 | R | dn | |
| Kp_gent | KP1_4873 | 89-188 | ATGACACCAACGCCCGCCACTTTGCCGGCCTTAATTTCACCGAAAAGAAA CTGCAGGAAGCCGTCAGCTTTGTGCATCAGCACCGTCGTAAGCTGCATAT | SEQ ID NO: 347 | R | dn | |
| Kp_gent | KP1_5122 | 390-489 | ATCTGATCAATAATCCGGTGATCCATGACGCGATGCGCTTTTTCCTGCGC CATCAGCCGGAGAATATGACCCTGGTGGTCCTGTCGCGTAACCTGCCGCA | SEQ ID NO: 348 | R | dn | |
| Kp_gent | KP1_5513 | 63-162 | CGAAAAAATCCAGGTAACGGGTAGCGAAGGTGAACTGGGTATTTACCCGG GCCACGCGCCGCTGCTCACCGCCATTAAGCCTGGTATGATTCGCATCGTT | SEQ ID NO: 349 | R | dn | |
| Kp_gent | KP1_5514 | 672-771 | CTGACCATGGCTGAGAAATTCCGTGACGAAGGTCGTGACGTACTGCTGTT CGTCGATAACATCTATCGTTACACCCTGGCCGGTACTGAAGTATCCGCGC | SEQ ID NO: 350 | R | dn | |
| Kp_gent | KP1_5515 | 425-524 | TAACCCATCCCTGTCCGAACTGATCGGCCCGGTAAAAGTGATGTTGCAGG CCTATGATGAAGGCCGTCTGGACAAGCTGTACGTTGTCAGCAACAAATTT | SEQ ID NO: 351 | R | dn | |
| Kp_gent | KP1_0325 (KPN_04462 (soxS)) | 1-100 | ATGTCCCATCAGGATATTATTCAAACTTTGATTGAATGGATTGATGAACA TATCGATCAACCACTTAACATTGATATAGTCGCCAGAAAGTCAGGATACT | SEQ ID NO: 352 | R | up | x |
| Kp_gent | KP1_0533 | 2300-2399 | CGCTGGAACCCGGCCGATCTCGGGCGCTTTATGGTCTTCTTTGGACCGAT CAGCTCGATTTTCGATATCCTCACCTTCGGCCTGATGTGGTGGGTGTTCC | SEQ ID NO: 353 | R | up | |
| Kp_gent | KP1_0837 (KPN_00016 (nhaA)) | 468-567 | TGGCGCTGTTAGGTAGCCGGGTCCCGACGGCGCTGAAGATTTTCCTGATG GCGCTGGCGATTATTGATGACCTCGGGGCTATCGTGATTATCGCGCTGTT | SEQ ID NO: 354 | R | up | x |
| Kp_gent | KP1_0838 (KPN_00017 (nhaR)) | 403-502 | TGGAGCAGCTGAGCCAGCATAAGCTCGACATGATTATCTCTGACTGCCCG ATCGACTCGACGCAGCAGGAAGGGCTATTTTCGGTGAAGATCGGCGAGTG | SEQ ID NO: 355 | R | up | x |
| Kp_gent | KP1_2104 | 107-206 | TAGGCACCATCTCTGCTTCTGCCGGGACTAACCTGGGCTCGCTGGAAGAC CAGCTGGCGCAGAAAGCGGATGAGATGGGCGCCACTTCATACCGTATTAC | SEQ ID NO: 356 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Kp_gent | KP1_2658 (KPN_01624 (marA)) | 107-206 | CCGGTTACTCTAAGTGGCACCTGCAACGTATGTTTAAGAAAGAGACCGGC CATTCCCTCGGCCAGTACATCCGCAGCCGCAAGCTGACGGAGATTGCGCA | SEQ ID NO: 357 | R | up | x |
| Kp_gent | KP1_2659 | 65-164 | ACCAGAAAAAAGATCGCCTGCTCAATGACTACCTCTCACCTATGGATATT ACCGCGACCCAGTTTCGCGTGCTCTGCTCCATTCGTTGCGAAGTATGTAT | SEQ ID NO: 358 | R | up | |
| Kp_gent | KP1_2873 | 406-505 | GAGGCGGCGCAGCGCATTCATGCCTTGCCGGGGGCCGGTGACGAAGAGAA ACGCTATGTCTTACGCGTCACCTGTCTGCGCGAACATGAAAATGCCGTAC | SEQ ID NO: 359 | R | up | |
| Kp_gent | KP1_3472 (KPN_02345 (htpX)) | 1-100 | ATGATGCGAATCGCGCTTTTCCTGCTGACGAACCTGGCAGTGATGGTCGT GTTCGGGCTGGTGTTAAGCCTCACGGGGATCCAATCCAGCAGCATGACCG | SEQ ID NO: 360 | R | up | x |
| Kp_gent | KP1_4962 | 121-220 | GCTGATATTATCAACAGCGAGCAGGCCCAGGGCCGCGAGGCCATCGGCAC GGTTTCCGTCGGCGCGGTAGCATCTTCCCCGATGGATATGCATGAAATGC | SEQ ID NO: 361 | R | up | |
| Kp_gent | KP1_5196 | 893-992 | CTTAAGCGGATCGGCATTGACCCGGCGGTAGTTTCCGCGCCGTTTATCGC CACGCTGATTGATGGCACCGGGCTAATTATCTATTTCAAAATCGCCCAGT | SEQ ID NO: 362 | R | up | |
| Kp_gent | KP1_5423 | 232-331 | AGCGGCTCACGTGGCGTGAAGGAAGCCAGTCGTCAGGCGGTGCTGCAGGC GGCGGAAGCGCTCAATTACCGGCCAAACATGATAGCCCAGTCGTTGCTCA | SEQ ID NO: 363 | R | up | |
| Kp_gent | KP1_5452 | 101-200 | ATATGCTGCGCCGCCTGGCGGAAAACTGGCAGAGCGGCAAAAACCGCTTT AACGCGCCGGGCGAAACGCTGCTGGGCGCCTTCGTCAACCACCAGCTGGT | SEQ ID NO: 364 | R | up | |
| Kp_gent | KP1_5467 (KPN_04090 (ibpB)) | 180-279 | TATTCAACTGGAAGGCACCCGTCTGGTGGTGAAAGGCACGCCGCAGCAGC CGGAAAAAGAGACCACATGGCTGCACCAGGGGTTGGTGAGCCAGGCCTTC | SEQ ID NO: 365 | R | up | x |
| Kp_gent | KP1_5468 (KPN_04091 (ibpA)) | 130-229 | CAGAGCAACGGCGGCTACCCTCCGTATAACGTCGAGCTGGTAGACGAAAA CCACTATCGCATCGCTATCGCGGTGGCTGGCTTTGCTGAAAGCGAGCTGG | SEQ ID NO: 366 | R | up | x |
| Ec_mero GeneID = NC_ 008563 (alt GeneID = NC_ 000913) | APECO78_ 00485 (b3940: metL) | 1-100 | ATGAGTGTGATTGCGCAGGCAGGGGCGAAAGGTCGTCAGCTGCATAAATT TGGTGGCAGTAGTCTGGCTGATGTGAAGTGTTATTTGCGTGTCGCGGGCA | SEQ ID NO: 367 | C | | x |
| Ec_mero | APECO78_ 02145 (b4235: pmbA) | 51-150 | TCTGGAAGAAGCAGTTTCCACTGCGCTGGAGTTGGCCTCAGGCAAATCGG ACGGTGCGGAAGTTGCCGTCAGCAAGACCACCGGCATTAGCGTAAGCACG | SEQ ID NO: 368 | C | | x |
| Ec_mero | APECO78_ 03915 | 656-755 | TTGGCTCGCTTTGTAGAACTTTATCCGGTTTTACAGCAGCAGGCGCAAAC CGATGGCAAACGGATTAGCTACGTTGATTTGCGTTATGACTCTGGAGCGG | SEQ ID NO: 369 | C | | |
| Ec_mero | APECO78_ 03920 (b0094: ftsA) | 624-723 | GATATCGGTGGTGGTACAATGGATATCGCCGTTTATACCGGTGGGGCATT GCGCCACACTAAGGTAATTCCTTATGCTGGCAATGTCGTGACCAGTGATA | SEQ ID NO: 370 | C | | x |
| Ec_mero | APECO78_ 05580 | 362-461 | GTCAGCCACGGGCTGATGATGAGTGAAGCCGAGCAATTGAATAAAGGCTT TCTCAAGCGGATGCGCACCGGCTTTCCTTATATTCAGTTAAAACTTGGCG | SEQ ID NO: 371 | C | | |
| Ec_mero | APECO78_ 05715 (b0438: clpX) | 935-1034 | AACGTTGAATGAACTGAGCGAAGAAGCTCTGATTCAGATCCTCAAAGAGC CGAAAAACGCCCTGACCAAGCAGTATCAGGCGCTGTTTAATCTGGAAGGC | SEQ ID NO: 372 | C | | x |
| Ec_mero | APECO78_ 09610 | 170-269 | AGGACGGTCTGTCACTGATTCGCCGCTGGCGTAGCAATGATGTTTCACTG CCGATTCTGGTATTAACCGCCCGTGAAAGCTGGCAGGACAAAGTCGAAGT | SEQ ID NO: 373 | C | | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Ec_mero | APECO78_ 13105 | 190-289 | AACGGAAAACTGCGCATCGGCTATGTACCGCAGAAGCTGTATCTCGACAC CACGTTGCCACTGACCGTAAACCGTTTTTTACGCTTACGCCCTGGTACAC | SEQ ID NO: 374 | C | | |
| Ec_mero | APECO78_ 16235 (b2502: ppx) | 987-1086 | GAACAGGCCCGACGGGTGCTGGATACCACTATGCAAATGTACGAACAGTG GCGGGAACAGCAACCGAAGCTGGCGCATCCGCAACTGGAGGCGCTACTGC | SEQ ID NO: 375 | C | | x |
| Ec_mero | APECO78_ 16510 | 1353-1452 | AGGGCAGCGGTCTGGGATTAAGCATTGCCAGGGATTGTATTCGCCGTATG CAAGGGGAACTGTATCTGGTCGACGAGAGCGGGCAAGACGTTTGTTTCCG | SEQ ID NO: 376 | C | | |
| Ec_mero | APECO78_ 17535 (b2784: relA) | 289-388 | GAGAGCGTCGGTAAGTCGGTCGTTAACCTTATTCACGGCGTGCGTGATAT GGCGGCGATCCGCCAGCTGAAAGCGACGCACACTGATTCTGTTTCCTCCG | SEQ ID NO: 377 | C | | x |
| Ec_mero | APECO78_ 19825 (b3197: kdsD) | 645-744 | ATGCATACGGGCGATGAGATCCCGCATGTTAAGAAAACGGCCAGTCTGCG TGACGCATTGCTGGAAGTTACCCGCAAAAATCTTGGTATGACTGTCATTT | SEQ ID NO: 378 | C | | x |
| Ec_mero | APECO78_ 19830 | 186-285 | CGTTGTGCGCTCACCTCTGATATTGAAGTCGCTATCATTACCGGGCGAAA GGCTAAACTGGTAGAAGATCGTTGTGCCACATTGGGGATCACTCACTTGT | SEQ ID NO: 379 | C | | |
| Ec_mero | APECO78_ 20780 (b3398: yrfF) | 1327-1426 | ACAAAGCGACGGCATTGACTGAAGCAGTTAATCGCCAGCTGCACCCTAAA CCGGAAGATGAATCTCGCGTCAGTGCCTCATTACGTTCAGCAATTCAAAA | SEQ ID NO: 380 | C | | x |
| Ec_mero | APECO78_ 21435 | 1011-1110 | GTCAGCAAGTGCTCACTATCATGAGCGAGCGCCTGCCGATTGAACGTATT CAACTCCGTCCGCACTGTAGCATTGGCGTGGCGATGTTCTACGGCGATCT | SEQ ID NO: 381 | C | | |
| Ec_mero | APECO78_ 01050 | 279-378 | TCTGCAGGATGGCGCTATCAGCGCTTATGATCTGCTTGATTTGCTGCGCG AAGCTGAACCGCAAGCCAAGCCGCCAACGGTTTATCGCGCGCTGGATTTT | SEQ ID NO: 382 | R | dn | |
| Ec_mero | APECO78_ 08635 | 844-943 | TGCGCAATACCAGTTCGATTTCGGTCTGCGTCCGTCCATCGCTTACACCA AATCTAAAGCGAAAGACGTAGAAGGTATCGGTGATGTTGATCTGGTGAAC | SEQ ID NO: 383 | R | dn | |
| Ec_mero | APECO78_ 12200 | 1-100 | ATGAAAGCTACTAAACTGGTACTGGGCGCGGTAATCCTGGGTTCTACTCT GCTGGCAGGTTGCTCCAGCAACGCTAAAATCGATCAGCTGTCTTCTGACG | SEQ ID NO: 384 | R | dn | |
| Ec_mero | APECO78_ 16640 | 267-366 | AAGATGCAGTTAAGCATCCGGAAAAAATATCCGCAGCTGACCATCCGTGTA TCCGGTTATGCAGTTCGCTTTAACTCTCTGACTCCGGAACAGCAGCGCGA | SEQ ID NO: 385 | R | dn | |
| Ec_mero | APECO78_ 22630 | 277-376 | CAGCTGCAAAAACACCAGGGAAATACCATTGAAATTCGTTACACCACGCA TGAACAATTCAAACAACAAACCGCAGAAAGTCAGGCGGTAATTCGCAGCG | SEQ ID NO: 386 | R | dn | |
| Ec_mero | APECO78_ 00325 (b4484 (cpxP)) | 149-248 | AAGTTTAACCGAACATCAGCGTCAGCAGATGCGAGATCTTATGCAACAGG CCCGGCACGAACAGCCTCCTGTTAATGTTAGCGAACTGGAGACAATGCAT | SEQ ID NO: 387 | R | up | |
| Ec_mero | APECO78_ 00495 | 133-232 | ATCGATCGCCTTAGCAGCCTGAAACCGAAGTTTGTATCGGTGACCTATGG CGCGAACTCCGGCGAGCGCGACCGTACGCACAGCATTATTAAAGGCATTA | SEQ ID NO: 388 | R | up | |
| Ec_mero | APECO78_ 00935 | 111-210 | TGGGACAGTCTGTTCGGCACGCCAGGCGTACAGCTGACGGACGATGATAT TCAAAATATGCCCTACGCCAGCCAGTACATGCAGCTTAATGGCGGGCCGC | SEQ ID NO: 389 | R | up | |
| Ec_mero | APECO78_ 00940 | 572-671 | GGACGCACGCAAAAAGCGCCGGTGGCTTACTGGAACAAGCGTCACGTAGA GCCGATGCCCGGCAGCATTATTTATGTTGGCCTCGCGGACTCCGTCTGGA | SEQ ID NO: 390 | R | up | |
| Ec_mero | APECO78_ 00945 | 1408-1507 | CAACTACGACAAGTTTAACTACACCAATCCGCCGCAGGACTCGCACTTAC CGCGCGTGCGTACCCATGTGCGCGAGTATGTGCAGAACGATGTCTATGTG | SEQ ID NO: 391 | R | up | |
| Ec_mero | APECO78_ 03465 | 695-794 | ATACCTGCGACCCGCGTCAGGTGCCCGATGCGAGGTTGTTGAAGTCGATG TCCTACCAGGAAGCGATGGAGCTTTCCTACTTCGGCGCTAAAGTTCTTCA | SEQ ID NO: 392 | R | up | |
| Ec_mero | APECO78_ 03815 | 578-677 | GCAGGCGGCACCGGGCATGTGGTGGAGTTTTGCGGCGAAGCAATCCGTGA TTTAAGCATGGAAGGTCGTATGACCCTGTGCAATATGGCAATCGAAATGG | SEQ ID NO: 393 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_mero | APECO78_ 03820 | 712-811 | ATCACAGTTTGACGTTCTGCTGTGCTCCAACCTGTTTGGCGACATTCTGT CTGACGAGTGCGCAATGATCACTGGCTCGATGGGGATGTTGCCTTCCGCC | SEQ ID NO: 394 | R | up | |
| Ec_mero | APECO78_ 03825 | 809-908 | CACACCGCCATTAATCACCAGGAGATATGGCGCACCAGCCAGTTAGTTAG CCAGATTTGTAATATGCCGATCCCGGCAAACAAAGCCATTGTTGGCAGCG | SEQ ID NO: 395 | R | up | |
| Ec_mero | APECO78_ 04245 (b0161 (degP)) | 164-263 | TTAACGTAGAAGGTAGCACAACCGTTAATACGCCGCGTATGCCGCGTAAT TTCCAGCAGTTCTTCGGTGATGATTCTCCGTTCTGCCAGGAAGGTTCTCC | SEQ ID NO: 396 | R | up | |
| Ec_mero | APECO78_ 04985 | 4-103 | CCTTTACGACGGTTCTCCCCAGGACTGAAAGCCCAGTTTGCCTTCGGCAT GGTCTTTTTGTTCGTTCAGCCCGATGCCAGCGCTGCTGACATAAGTGCGC | SEQ ID NO: 397 | R | up | |
| Ec_mero | APECO78_ 04995 | 190-289 | ACGCCACTCGGTAGCCTGGCGTTCCAGTATGCCGAAGGCATTAAAGGTTT TAACTCACAGAAAGGTCTATTTGACGTGGCTATCGAGGGTGACTCAACGG | SEQ ID NO: 398 | R | up | |
| Ec_mero | APECO78_ 05000 | 227-326 | CCGTGATAATGAGTGGTTATCCGCGGTAAAGGGGAAACAGGTCGTATTGA TTGCGGCCAGAAAGTCAGAAGCCTTAGCAAATTATTGGTATTACAACAGC | SEQ ID NO: 399 | R | up | |
| Ec_mero | APECO78_ 05395 (b0379 (yaiY)) | 177-276 | GGAAACAGGTCGCCCACGGGTGGAAATTGGTTTAGGTGTCGGCACCATTT TCGGGCTGATCCCGTTTTTAGTAGGCTGCCTCATTTTTGCAGTGGTGGCG | SEQ ID NO: 400 | R | up | |
| Ec_mero | APECO78_ 05500 (b0399 (phoB)) | 47-146 | AAATGGTCTGCTTCGTGCTCGAACAAAATGGCTTTCAGCCGGTCGAAGCG GAAGATTATGACAGTGCTGTGAATCAACTGAATGAACCCTGGCCGGATTT | SEQ ID NO: 401 | R | up | |
| Ec_mero | APECO78_ 05505 | 524-623 | TGGAAATTCGCGTCATGCCTTATACCCACAAACAGTTGCTGATGGTGGCG CGTGATGTCACGCAAATGCATCAACTGGAAGGGGCGCGGCGTAACTTTTT | SEQ ID NO: 402 | R | up | |
| Ec_mero | APECO78_ 05995 | 181-280 | GACGGCAGCAGTGGCGAAGTGAGTCTGGTGGGACAACCGCTACATAATAT GGACGAAGAAGCGCGGGCAAAGTTGCGCGCGAAGCACGTCGGCTTTGTTT | SEQ ID NO: 403 | R | up | |
| Ec_mero | APECO78_ 09510 (b1110 (ycfJ)) | 393-492 | AGCGATACTTACACGACTACGCAACAGCGTTGTAAAACGGTGTATGACAA GTCAGAAAAAATGCTCGGTTATGATGTGACCTATAAGATTGGCGATCAGC | SEQ ID NO: 404 | R | up | |
| Ec_mero | APECO78_ 09535 | 513-612 | TACTGCTGAGTGTGGCGGTTAATTTCGTTCCCACGCCGTGGTGGGGAATG AACAGTGTGATCCGCAATTTGCCTTATTACAGCCTTGGCGCATGGTTTGG | SEQ ID NO: 405 | R | up | |
| Ec_mero | APECO78_ 09705 (b1171 (ymgD)) | 120-219 | CCAACGAAATGGCAAAAACTGACAGCGCACAGGTTGCAGAAATTGTTGCG GTAATGGGTAATGCCAGCGTTGCCAGCCGTGATTTAAAAATTGAGCAATC | SEQ ID NO: 406 | R | up | |
| Ec_mero | APECO78_ 09710 (b1172 (ymgG)) | 105-204 | AGGCGTTGGTTTACTTACTGGCAATGGTGTTAATGGCGTACTGAAAGGTG CAGCTGTTGGCGCTGGTGTTGGTGCAGTAACAGAAAAAGGCCGCGACGGT | SEQ ID NO: 407 | R | up | |
| Ec_mero | APECO78_ 10895 | 58-157 | CTCATGGCAGGGCACAAAGGACATGAATTTGTGTGGGTAAAGAATGTGGA TCATCAGCTGCGTCATGAAGCGGACAGCGATGAATTGCGTGCTGTGGCGG | SEQ ID NO: 408 | R | up | |
| Ec_mero | APECO78_ 11400 | 60-159 | GGTTAATCAGAAGAAAGATCGTCTGCTTAACGAGTATCTGTCTCCGCTGG ATATTACCGCGGCACAGTTTAAGGTGCTCTGCTCTATCCGCTGCGCGGCG | SEQ ID NO: 409 | R | up | |
| Ec_mero | APECO78_ 12545 (b1743 (spy)) | 309-408 | ACCTTCGATAAAGCAAAAGCTGAAGCGCAGATCGCAAAAATGGAAGAACA GCGCAAAGCTAACATGCTGGCGCACATGGAAACCCAGAACAAAATTTACA | SEQ ID NO: 410 | R | up | |
| Ec_mero | APECO78_ 13545 | 395-494 | ATGCCGACGTTATCATTGAGCCGAACCGAATCGAGTATGTTGCGAATGTG GATGGCAGGTCAGGGAACCATTCAAATCTCTGACCAAATGAATATCAAAG | SEQ ID NO: 411 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_mero | APECO78_ 13965 | 19-118 | CGCGAGCGAGCGAAAACCAATGCATCGTTAATCTCTATGGTGCAACGCTT TTCAGATATCACCATCATGTTTGCCGGACTATGGCTGGTTTGCGAAGTGA | SEQ ID NO: 412 | R | up | |
| Ec_mero | APECO78_ 13975 | 522-621 | CCTTTGAAGTGGCGCAGTTTGTCGAAAAACCGAATCTGGAAACCGCCCAG GCCTATGTGGCAAGCGGCGAATATTACTGGAACAGCGGTATGTTCCTGTT | SEQ ID NO: 413 | R | up | |
| Ec_mero | APECO78_ 13985 | 125-224 | AGGGTTACTGGTTTGTGCCGGGAGGGCGCGTGCAGAAAGACGAAACGCTG GAAGCCGCATTTGAGCGGCTGACGATGGCGGAACTGGGGCTGCGTCTGCC | SEQ ID NO: 414 | R | up | |
| Ec_mero | APECO78_ 13995 | 647-746 | CTCGGCAATATGGATTCCCTGCGTGACTGGGGCCATGCCAAAGACTACGT AAAAATGCAGTGGATGATGCTGCAACAGGAACAGCCGGAAGATTTCGTTA | SEQ ID NO: 415 | R | up | |
| Ec_mero | APECO78_ 14000 | 259-358 | TATACCCTCGGTGAAATAACCATTGGCGCACATTCGGTGATATCGCAAAA AAGTTATTTATGCACCGGTAGCCACGACCATGCAAGTCAACATTTCACCA | SEQ ID NO: 416 | R | up | |
| Ec_mero | APECO78_ 14010 | 523-622 | CGAACCGGCATTTTTCGCTCTGGCATTAATCTCAATTTGGCTCAGCATCA AACAGTTTGGTATCAAAACGCCTAAAACCGATGCTATGATTCTCGCAGGG | SEQ ID NO: 417 | R | up | |
| Ec_mero | APECO78_ 14025 | 475-574 | AGGTCTTTACCTGGGCGTGGCGTTTCAAAGAGTGTTTGTTCGATACCGAA CTGAAAGCGGCACAGGATTACGACATCTTCCTGCGGATGGTGGTGGAGTA | SEQ ID NO: 418 | R | up | |
| Ec_mero | APECO78_ 14030 | 2020-2119 | ATGGTGGCGCGTTATGCGGTCAACACATTGAAAGAAGTGGAAACCAGTCT GAGCCGCTTTGAGCAAAACGGTATTCCGGTGAAAGGGGTGATTCTGAACT | SEQ ID NO: 419 | R | up | |
| Ec_mero | APECO78_ 14035 | 231-330 | CTGATTTTGACCATGGAAAAGCGCCATATCGAACGCTTATGCGAGATGGC ACCTGAGATGCGCGGCAAAGTGATGCTGTTTGGTCACTGGGATAACGAAT | SEQ ID NO: 420 | R | up | |
| Ec_mero | APECO78_ 14040 | 1035-1134 | CCCGGTTTCCCGCTGGAACCGTCTGATCAATCAGTTGCTGCCAACTATTA GCGGTGTCCGTTACATGACGGATACAGCCAGCGACATTCATAACTGGTAA | SEQ ID NO: 421 | R | up | |
| Ec_mero | APECO78_ 14100 | 153-252 | AGGCAGTTATAAATCCCGTTGGGTAATCGTAATCGTGGTGGTTATCGCCG CCATCGCCGCATTCTGGTTCTGGCAAGGCCGCAATGACTCCCAGAGTGCA | SEQ ID NO: 422 | R | up | |
| Ec_mero | APECO78_ 15715 | 22-121 | GCGGCCGCCCTGATGGCATTTACCCCGCTTGCAGCAAACGCAGGTGAAAT CACCCTACTGCCATCAATCAAATTACAAATTGGCGATCGCGATCATTACG | SEQ ID NO: 423 | R | up | |
| Ec_mero | APECO78_ 19610 | 111-210 | CGAGTTCCGTAAAGCCGGACACGAAGTGATTACCATTGAAAAACAAGCGG GTAAAACGGTGAAAGGCAAAAAAGGAGAAGCCAGCGTGACCATCGATAAA | SEQ ID NO: 424 | R | up | |
| Ec_mero | APECO78_ 21920 (b3615 (waaH)) | 788-887 | TTCATCAGCAAATAACTTACGAAGCATTGCGTGTTTGCCATGCGGTGCGC AAAGAGCCGGATATTCTTACCCGCCAACGGATGATTGCCGAGATATTTAC | SEQ ID NO: 425 | R | up | |
| Ec_mero | APECO78_ 22490 | 263-362 | TGGTTATGGTGATCAGTAAAACCATTGCCGAGCTGGAGCGTATTGGCGAC GTGGCGGACAAAATCTGCCGTACTGCGCTGGAGAAATTCTCCCAGCAGCA | SEQ ID NO: 426 | R | up | |
| Ec_mero | APECO78_ 22505 | 5-104 | CTGCAACCAAGCCTGCTTTTAACCCACCGGGTAAAAAGGGCGACATAATT TTCAGCGTGCTGGTAAAACTGGCGGCGCTGATTGTGCTATTGATGTTGGG | SEQ ID NO: 427 | R | up | |
| Ec_mero | APECO78_ 22510 (b3728 (pstS)) | 9-108 | TATGCGTACCACCGTCGCAACTGTTGTCGCCCGCGACCTTATCGATGAGCG CTTTCTCTGTGTTTGCAGAAGCAAGCCTGACAGGTGCAGGTGCAACCTTC | SEQ ID NO: 428 | R | up | |
| Ec_mero | APECO78_ 22685 | 525-624 | AAAACGAAGTGACTTTCCCACATGCCGAAGTTGAGCAAGCGCGCCAGATG CTGGCAAAAGCGCAAAAACCGATGCTGTACGTTGGCGGTGGCGTGGGTAT | SEQ ID NO: 429 | R | up | |
| Ec_cip GeneID = NC_ 000913 | b0176 | 432-531 | GTGGTTGGTGAAATAGCAGCCAATTCGATAGCTGCGGAAGCACAAATTGC ACCAGGTACGGAACTAAAAGCCGTAGATGGTATCGAAACGCCTGATTGGG | SEQ ID NO: 430 | C | | x |
| Ec_cip | b0179 | 374-473 | TCCGGCGTTGAACTGGGCGATAACGTGATTATCGGTGCCGGTTGCTTCGT AGGTAAAAACAGCAAAATCGGTGCAGGTTCGCGTCTCTGGGCGAACGTAA | SEQ ID NO: 431 | C | | |
| Ec_cip | b0761 | 223-322 | GGCGCAGTACTGACCCGCTATGGTCAGCGACTGATTCAGCTCTATGACTT ACTGGCGCAAATCCAGCAAAAAGCCTTTGATGTGTTAAGTGACGATGACG | SEQ ID NO: 432 | C | | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_cip | b1280 | 439-538 | TGCTACAAATCTACCAGGCTACCAGTGAGTGGCAGAAAGCAATTGATGTT GCCGAACGCCTGGTGAAGCTGGGTAAAGATAAACAGCGCGTCGAAATTGC | SEQ ID NO: 433 | C | | x |
| Ec_cip | b1827 | 1-100 | ATGGCTAACGCAGATCTGGATAAACAGCCTGATTCTGTATCTTCCGTGCT AAAAGTTTTTGGCATTTTGCAGGCGCTGGGTGAAGAGCGCGAAATAGGGA | SEQ ID NO: 434 | C | | x |
| Ec_cip | b1870 | 142-241 | ATGTTAGCCGAGCGCTTCGTTCAACCTGGTACGCAGGTTTACGATCTGGG TTGTTCTCTGGGCGCGGCGACGCTCTCGGTGCGTCGCAACATTCATCATG | SEQ ID NO: 435 | C | | |
| Ec_cip | b2065 | 100-199 | GATGTACGCCTGGGCAATAAATTTCGTACCTTCCGTGGTCACACGGCAGC GTTTATCGATCTGAGCGGTCCCAAAGATGAAGTGAGCGCCGCGCTTGACC | SEQ ID NO: 436 | C | | x |
| Ec_cip | b2153 | 167-266 | CTGATGACAGTTTGATGGAAACGCCGCATCGCATCGCTAAAATGTATGTC GATGAAATTTTCTCCGGTCTGGATTACGCCAACTTCCCGAAAATCACCCT | SEQ ID NO: 437 | C | | |
| Ec_cip | b2411 | 504-603 | GAAGTGCGTGGTGAAGTGTTCCTGCCGCAGGCGGGGTTCGAAAAGATTAA CGAAGATGCGCGACGCACGGGCGGGAAAGTGTTTGCTAACCCACGTAATG | SEQ ID NO: 438 | C | | |
| Ec_cip | b2515 | 277-376 | ATTGCGCTGAAAGTAGCGGAATACGGCGTCGATTGTCTGCGTATTAACCC TGGCAATATCGGTAATGAAGAGCGTATTCGCATGGTGGTTGACTGTGCGC | SEQ ID NO: 439 | C | | x |
| Ec_cip | b2516 | 91-190 | CAGGCCGTTGCCGAGCGACTTTGCCTGAAGGTTTCCACGGTACGCGACAT TGAAGAAGATAAGGCACCCGCCGATCTTGCTTCAACATTCCTGCGCGGAT | SEQ ID NO: 440 | C | | |
| Ec_cip | b2829 | 781-880 | GGTTGATAAAGGCTCGGTGGCAGAGTGGGCGGTAAAAACGGTCATTGAAA AATTTGCCGAACAGTTTGCCGCGCTAAGCGATAACTATCTCAAAGAGCGG | SEQ ID NO: 441 | C | | |
| Ec_cip | b2830 | 223-322 | TTGCGCTACAAATTACCGAAACGTTTGGTGCGTTGGGACACGAAGCCGGT TTGTATCGGCCAAAAACAAAAATGGTTTCTCTTGCAGCTGGTGAGCGGCG | SEQ ID NO: 442 | C | | x |
| Ec_cip | b2907 | 605-704 | TTTACGCAACATGGCCCGCTGGCGATGTTGCCGATGTCTGACGGACGCTG TTCGCTGGTCTGGTGTCATCCACTGGAACGGCGCGAAGAGGTGCTGTCGT | SEQ ID NO: 443 | C | | |
| Ec_cip | b3252 | 1103-1202 | CCACGCGTAATGCGGGATTGCAGGGCGGCAATAGCTGGGCTATTTACGAT GACTCGTTGCCTGAAAAAGGACGCGGTAATGTTCGCTGGCGTACGCTTAT | SEQ ID NO: 444 | C | | x |
| Ec_cip | b3346 | 176-275 | AGGATCTAAAATGTTCAGCCATTCGCATTGCTAACGGTGAACATACAGGC CGGAAGATTGGTTCGCCAATTACTGACCTGGCGCTACGTATGCTGCACGA | SEQ ID NO: 445 | C | | |
| Ec_cip | b3803 | 50-149 | CCGTGGACACCACGTCACAACCTGTCGCAACAGAAAAAAAGAGTAAGAAC AATACCGCATTGATTCTCAGCGCGGTGGCTATCGCTATTGCTCTGGCGGC | SEQ ID NO: 446 | C | | |
| Ec_cip | b4136 | 548-647 | GAGCAGCCCACCGCGCAATTGCCCTTTTCCGCGCTCTGGGCGTTGTTGAT CGGTATTGGTATCGCCTTTACGCCATGCGTGCTGCCAATGTACCCACTGA | SEQ ID NO: 447 | C | | |
| Ec_cip | b4175 | 175-274 | ATTGAAACGGTGAAAATGCTCGACGCACGTATTCAGACCATGGACAACCA GGCCGACCGCTTTGTGACCAAAGAGAAGAAAGACCTGATCGTCGACTCTT | SEQ ID NO: 448 | C | | |
| Ec_cip | b4178 | 208-307 | CGGCGAGTGCGATACGTATTGGTGATGTGGTGCGCGAGCTGGAGCCCTTA TCGCTGGTGAATTGCAGCAGTGAGTTTTGCCACATTACACCTGCCTGTCG | SEQ ID NO: 449 | C | | |
| Ec_cip | b0754 | 276-375 | GTCTATTTTGAAAAGCCGCGTACCACGGTGGGCTGGAAAGGGCTGATTAA CGATCCGCATATGGATAACAGCTTCCAGATCAACGACGGTCTGCGTATAG | SEQ ID NO: 450 | R | dn | |
| Ec_cip | b0893 | 488-587 | GTAATGAAAGGGCAGATTGCTCGCATGCACCGCGCACTGTCGCAGTTTAT GCTGGATCTGCATACCGAACAGCATGGCTACAGTGAGAACTATGTTCCGT | SEQ ID NO: 451 | R | dn | |
| Ec_cip | b0894 | 1466-1565 | TCTGAAATCAACCGTACCCATGAAATCCTTCAGGATGATAAGAAGTGCGA GCTGATTGTGGTTATCGACTGCCACATGACCTCATCGGCGAAATATGCTG | SEQ ID NO: 452 | R | dn | |
| Ec_cip | b0926 | 311-410 | CGCAAACCGGTGCAACTCATTTCCGGTTATCGTTCCATTGATACCAACAA TGAACTACGCGCCCGCAGCCGTGGAGTAGCGAAGAAAAGCTATCACACTA | SEQ ID NO: 453 | R | dn | |
| Ec_cip | b0929 | 1-100 | ATGATGAAGCGCAATATTCTGGCAGTGATCGTCCCTGCTCTGTTAGTAGC AGGTACTGCAAACGCTGCAGAAATCTATAACAAAGATGGCAACAAAGTAG | SEQ ID NO: 454 | R | dn | |
| Ec_cip | b1120 | 116-215 | AAAAACCAAGAGTACTCGTACTGACAGGGGCAGGGATTTCTGCGGAATCA GGTATTCGTACCTTTCGCGCCGCAGATGGCCTGTGGGAAGAACATCGGGT | SEQ ID NO: 455 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_cip | b1794 | 244-343 | ACCTACCTGACCAAAGTGGATGTCGAAGCGCGCCTGCAGCATATTATGTT TGCCCGTAACAGCCAGAAAATGCACATCCCGGAGAATTTTACCGTCTCGT | SEQ ID NO: 456 | R | dn | |
| Ec_cip | b1895 | 28-127 | GTTGCGGTTACACCGGAAAGTCAGCAACTGCTGGCAAAAGCGGTATCTAT CGCCAGGCCAGTAAAGGGACACATCAGTTTAATTACTCTCGCTTCCGACC | SEQ ID NO: 457 | R | dn | |
| Ec_cip | b2276 | 182-281 | TGGACGTTACGCCGCTGATGCGCGTTGATGGTTTCGCCATGCTTTACACC GGGCTGGTATTGTTGGCGAGCCTCGCCACCTGTACTTTCGCCTACCCGTG | SEQ ID NO: 458 | R | dn | |
| Ec_cip | b2277 | 421-520 | CTTCTGGGAAATGATGCTGGTGCCGATGTACTTCCTGATCGCACTGTGGG GGCATAAAGCCTCTGACGGTAAAACGCGTATCACGGCGGCAACCAAGTTC | SEQ ID NO: 459 | R | dn | |
| Ec_cip | b2281 | 47-146 | GTATCTGGATGATCGGCCTGCACGCGTTCGCCAAACGCGAAACGCGAATG TACCCGGAAGAGCCGGTCTATCTGCCGCCCCGTTATCGTGGTCGTATCGT | SEQ ID NO: 460 | R | dn | |
| Ec_cip | b2903 | 1501-1600 | CTCACCCATCCGGTGTTTAATCGCTACCACAGCGAAACCGAAATGATGCG CTATATGCACTCGCTGGAGCGTAAAGATCTGGCGCTGAATCAGGCGATGA | SEQ ID NO: 461 | R | dn | |
| Ec_cip | b3409 | 824-923 | CCACTGCGGTAGATAAAATCGTGCTCAACCGTTTCCTCGGTCTGCCGATT TTCCTCTTTGTGATGTACCTGATGTTCCTGCTGGCTATCAACATCGGCGG | SEQ ID NO: 462 | R | dn | |
| Ec_cip | b3746 | 495-594 | CGGAAGCAGACAGCAGTCTGGAAGCGTTATATGACCGCATGCTGATTCGT CTGTGGTTAGATAAAGTGCAGGATAAAGCGAATTTCCGCTCCATGCTGAC | SEQ ID NO: 463 | R | dn | |
| Ec_cip | b3771 | 967-1066 | AAGATGTTCACCGTGCTGGTGGTGTTATCGGTATTCTCGGCGAACTGGAT CGCGCGGGGTTACTGAACCGTGATGTGAAAAACGTACTTGGCCTGACGTT | SEQ ID NO: 464 | R | dn | |
| Ec_cip | b3863 | 693-792 | TGGCAGCGAAGCTCGAGCAAAACAAAGAAGTTGCTTATCTCTCATACCAG CTGGCGACGATTAAAACCGACGTTGAACTGGAGCTGACCTGTGAACAACT | SEQ ID NO: 465 | R | dn | |
| Ec_cip | b0060 | 865-964 | CTTCATTCTCGCTGGAAACTGTCGCTCAGGAGCTATTAGGCGAAGGAAAA TCTATCGATAACCCGTGGGATCGAATGGACGAAATTGACCGCCGTTTCGC | SEQ ID NO: 466 | R | up | |
| Ec_cip | b0068 | 577-676 | AAAACGGTCACGGTCACCAAAGGCTGGAGCGAAGCCTACGGCCTGTTTTT AAAAGGTGAAAGCGATCTGGTACTGAGTTACACCACCTCTCCGGCTTATC | SEQ ID NO: 467 | R | up | |
| Ec_cip | b0231 | 102-201 | CCGCGAACGTCGGGGGGTGATCAGCACCGCCAATTATCCCGCGCGTAAAT TTGGCGTACGTAGCGCTATGCCGACAGGGATGGCGCTCAAATTATGCCCG | SEQ ID NO: 468 | R | up | |
| Ec_cip | b0241 | 367-466 | CGTGGAAGCCTGGACCGATATGTTCCCGGAATTTGGTGGCGACTCCTCGG CGCAGACCGACAACTTTATGACCAAACGCGCCAGCGGTCTGGCGACGTAT | SEQ ID NO: 469 | R | up | |
| Ec_cip | b0313 | 137-236 | GCGTTTCTACGGGGATCATCAGCCACTATTTCAGGGACAAAAATGGTCTG CTGGAAGCAACCATGCGCGATATCACCAGTCAGCTGCGTGACGCGGTTTT | SEQ ID NO: 470 | R | up | |
| Ec_cip | b0399 | 46-145 | GAAATGGTCTGCTTCGTGCTCGAACAAAATGGCTTTCAGCCGGTCGAAGC GGAAGATTATGACAGTGCTGTGAATCAACTGAATGAACCCTGGCCGGATT | SEQ ID NO: 471 | R | up | |
| Ec_cip | b0400 | 334-433 | GTGCTGACCACGGAAGAGGGCGGTATTTTCTGGTGTAACGGTCTGGCGCA ACAAATTCTTGGTTTGCGCTGGCCGGAAGATAACGGGCAGAACATCCTTA | SEQ ID NO: 472 | R | up | |
| Ec_cip | b0458 | 275-374 | TCGATGTCTACCCACGCTACCGCTATGAAGATATCGACGTGCTGGATTTC CGCGTTTGCTATAACGGCGAATGGTACAACACGCGCTTTGTACCTGCCGC | SEQ ID NO: 473 | R | up | |
| Ec_cip | b0683 | 116-215 | TATACAAACGTCTGATCGATATGGGTGAAGAAATTGGTCTGGCTACGGTA TATCGCGTACTGAACCAGTTTGACGACGCTGGTATCGTCACCCGCCACAA | SEQ ID NO: 474 | R | up | |
| Ec_cip | b0698 | 1234-1333 | TACGGCATGATGCTGTTTGTCCTGCTGGCGGTGTTTATTGCCGGGCTGAT GATTGGTCGTACACCGGAATATCTGGGTAAAAAAATCGACGTACGCGAGA | SEQ ID NO: 475 | R | up | |
| Ec_cip | b0779 | 881-980 | GAGATGATGAACGAGCTGGGCTACTGTTCGGGGATTGAAAACTACTCGCG CTTCCTCTCCGGTCGTGGACCGGGTGAGCCACCGCCGACGCTGTTTGATT | SEQ ID NO: 476 | R | up | |
| Ec_cip | b0958 | 114-213 | TGTCTATCGCGAAGATCAGCCCATGATGACGCAACTTCTACTGTTGCCAT TGTTACAGCAACTCGGTCAGCAATCGCGCTGGCAACTCTGGTTAACACCG | SEQ ID NO: 477 | R | up | |
| Ec_cip | b1061 | 134-233 | TGCGAATTGAAGTCACCATAGCGAAAACTTCTCCATTGCCAGCTGGGGCT ATTGACGCCCTGGCTGGCGAACTTTCCCGCCGTATTCAGTATGCGTTTCC | SEQ ID NO: 478 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_cip | b1183 | 129-228 | GTTGATCCAGCATCCCAGCGCGACTTACTTCGTCAAAGCAAGTGGTGATT CTATGATTGATGGTGGAATTAGTGACGGTGATTTACTGATTGTCGATAGC | SEQ ID NO: 479 | R | up | |
| Ec_cip | b1184 | 453-552 | CGGCAAAAAAATGGCAGCGGCAGACGGGTGGGGTGGTGGATTTATCAAAT CTGGAACGCCAGCGTAAATTAATGTCTGCTCTCCCCGTGGATGACGTCTG | SEQ ID NO: 480 | R | up | |
| Ec_cip | b1207 | 255-354 | AACGACAACCTGATGGAATTAGTCGTTATGGTTGATGCCCTGCGTCGTGC TTCCGCAGGTCGTATCACCGCTGTTATCCCCTACTTTGGCTATGCGCGCC | SEQ ID NO: 481 | R | up | |
| Ec_cip | b1728 | 40-139 | TCTATTGCTTGTGCGGTATTTGCCAAAAATGCCGAGCTGACGCCCGTGCT GGCACAGGGTGACTGGTGGCATATTGTCCCTTCCGCAATCCTGACGTGTT | SEQ ID NO: 482 | R | up | |
| Ec_cip | b1848 | 117-216 | CACCTGGCTGACAAATTCTCCAGTGCAAATGGAAGACGAGCAACGTGAAG CCCTTTCGCTATGGCTGGCAGAACAAAAAGATGTGCTGAGCACCATTCTG | SEQ ID NO: 483 | R | up | |
| Ec_cip | b2231 | 100-199 | CTGCCAGATGTCCGAGATGGCCTGAAGCCGGTACACCGTCGCGTACTTTA CGCCATGAACGTACTAGGCAATGACTGGAACAAAGCCTATAAAAAATCTG | SEQ ID NO: 484 | R | up | |
| Ec_cip | b2234 | 21-120 | GACAAAGCGCGACGGTAGCACAGAGCGCATCAATCTCGACAAAATCCATC GCGTTCTGGATTGGGCGGCAGAAGGACTGCATAACGTTTCGATTTCCCAG | SEQ ID NO: 485 | R | up | |
| Ec_cip | b2498 | 318-417 | GTTGTCGGTATGTACCGTAATGAAGAAACGCTGGAGCCGGTACCGTACTT CCAGAAACTGGTTTCTAACATCGATGAGCGTATGGCGCTGATCGTTGACC | SEQ ID NO: 486 | R | up | |
| Ec_cip | b2582 | 110-209 | TGATTAATGCGACCGGTGAAACGCTCGACAAATTGCTGAAGGATGATCTA CCTGTGGTGATCGACTTCTGGGCACCGTGGTGCGGCCCCTGCCGTAATTT | SEQ ID NO: 487 | R | up | |
| Ec_cip | b2616 | 597-696 | TAATCCGCAGCCCGGAGAGTTTGAACAAATCGACGAAGAGTACAAACGTC TGGCGAACAGCGGTCAATTGCTGACCACCAGCCAGAATGCATTGGCATTA | SEQ ID NO: 488 | R | up | |
| Ec_cip | b2670 | 153-252 | GAACATCTTAATTGCATGGCCATACGGTATGTACCGCGATCTGTTTATGC GCGCGGCACGCAAAGTTAGCCCGTCGGGCTGGATAAAAAATCTGGCGGAT | SEQ ID NO: 489 | R | up | |
| Ec_cip | b2698 | 310-409 | AAGCGACAGAAAAAGCGATGCGTGAATGTGACATCGACTGGTGCGCACTG GCGCGCGATCAGGCGACGCGAAAATATGGCGAACCTTTGCCAACTGTCTT | SEQ ID NO: 490 | R | up | |
| Ec_cip | b2699 | 40-139 | AAAGCGTTGGCGGCAGCACTGGGCCAGATTGAGAAACAATTTGGTAAAGG CTCCATCATGCGCCTGGGTGAAGACCGTTCCATGGATGTGGAAACCATCT | SEQ ID NO: 491 | R | up | |
| Ec_cip | b2700 | 274-373 | TGAAAGCGGCTCGTGCTGATTATGCCGTGTCTATTAGTGGTATCGCCGGG CCGGATGGCGGCAGTGAAGAGAAGCCTGTCGGCACCGTCTGGTTTGCTTT | SEQ ID NO: 492 | R | up | |
| Ec_cip | b2980 | 427-526 | GATAACCCGCTGTTATGAAAAAATGCTCGCCGCCAGTGAGAACAACAAAG AGATTTCGCTGATCGAACATGCGCAGTTGGATCACGCTTTCCATCTCGCC | SEQ ID NO: 493 | R | up | |
| Ec_cip | b3065 | 56-155 | TCAAGCGTTCCTGCGAAAAAGCAGGTGTTCTGGCGGAAGTTCGTCGTCGT GAGTTCTATGAAAAACCGACTACCGAACGTAAGCGCGCTAAAGCTTCTGC | SEQ ID NO: 494 | R | up | |
| Ec_cip | b3173 | 625-724 | AGAGCATCAAAGATTACTCTCAATTGCAAACACGGTGCCGTATTTTCAAT TATCAGTCAGGGATACAGGTATTGATACCTACGTGTTGATTGTGGGGGAG | SEQ ID NO: 495 | R | up | |
| Ec_cip | b3348 | 41-140 | AGAGCCGACTGGCTTTTCAGGAAATCACCATTGAAGAACTGAACGTCACG GTGACCGCTCATGAAATGGAGATGGCGAAACTGCGCGATCATCTGCGTCT | SEQ ID NO: 496 | R | up | |
| Ec_cip | b3434 | 64-163 | CCTATTTTCATGTCCGTACTGAAACATACTGAACCGAAAAGACGGCGGGC AATCATGGTGCGAGAGTTGCTTATTGCTCTCCTGGTGATGCTGGTGTTCC | SEQ ID NO: 497 | R | up | |
| Ec_cip | b3452 | 487-586 | TTGCCTCAGTATGGAAGCAAATCAGCTACAACTTCCTGTTCTTCTATGCC GCGCTGCAATCCATTCCCCGTTCGTTGATCGAAGCCGCAGCCATCGACGG | SEQ ID NO: 498 | R | up | |
| Ec_cip | b3453 | 100-199 | AAGGGGAACTGGGTAAAGAGGTGGATTCTCTGGCCCAACGTTTTAACGCC GAAAACCCGGATTACAAAATTGTACCGACCTATAAAGGCAACTACGAACA | SEQ ID NO: 499 | R | up | |
| Ec_cip | b3645 | 256-355 | TTCATCTCTCCCGCTATGCCTGTTACCTGGTAGTACAAAACGGCGACCCT GCGAAACCGGTTATTGCGGCAGGGCAAACTTATTTTGCTATCCAGACCCG | SEQ ID NO: 500 | R | up | |
| Ec_cip | b3666 | 700-799 | AAGAGGACAAAGAGACAGAATCTACCGATATGACCAAGTGGCAGATCTTT GTTGAGTATGTGCTGAAAAACAAAGTGATCTGGCTGCTGTGCTTCGCCAA | SEQ ID NO: 501 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_cip | b3700 | 817-916 | GCTTAAGCTGTTGATGTGCGCCTTACGTCTGGCGCAAGGAGAGTTCCTCA CCCGTGAAAGCGGGCGGCGGTGTCTCTACCTGATAGATGATTTTGCCTCT | SEQ ID NO: 502 | R | up | |
| Ec_cip | b3701 | 37-136 | CCGCTACAACAGGTGAGCGGTCCGTTAGGTGGTCGTCCTACGCTACCGAT TCTCGGTAATCTGCTGTTACAGGTTGCTGACGGTACGTTGTCGCTGACCG | SEQ ID NO: 503 | R | up | |
| Ec_cip | b3702 | 370-469 | TCCCGGCCCCGGCAGAACCGACCTATCGTTCTAACGTAAACGTCAAACAC ACGTTTGATAACTTCGTTGAAGGTAAATCTAACCAACTGGCGCGCGCGGC | SEQ ID NO: 504 | R | up | |
| Ec_cip | b3727 | 5-104 | CTGCAACCAAGCCTGCTTTTAACCCACCGGGTAAAAAGGGCGACATAATT TTCAGCGTGCTGGTAAAACTGGCGGCGCTGATTGTGCTATTGATGTTGGG | SEQ ID NO: 505 | R | up | |
| Ec_cip | b3728 | 8-107 | TTATGCGTACCACCGTCGCAACTGTTGTCGCCGCGACCTTATCGATGAGC GCTTTCTCTGTGTTTGCAGAAGCAAGCCTGACAGGTGCAGGTGCAACCTT | SEQ ID NO: 506 | R | up | |
| Ec_cip | b3820 | 241-340 | GTGTGCGTGGGAAGTACCTTAACCCGCCACGAAACCATCAGTGAAGATGA ACTACGCCAGCGGCTATCGCGGATGGGGACCATTGATCTTCGCGTTGATT | SEQ ID NO: 507 | R | up | |
| Ec_cip | b3832 | 833-932 | CGCTACAGGAACATATCGCGTCGGTGCGTAACCATATCCGTTTGCTGGGA CGCAAAGATTATCAACAGCTGCCGGGGCTGCGAACTCTGGATTACGTGCT | SEQ ID NO: 508 | R | up | |
| Ec_cip | b3846 | 168-267 | AGATGGCATTGCCGAACTGGTATTTGATGCCCCAGGTTCAGTTAATAAAC TCGACACTGCGACCGTCGCCAGCCTCGGCGAGGCCATCGGCGTGCTGGAA | SEQ ID NO: 509 | R | up | |
| Ec_cip | b4043 | 11-110 | TAACGGCCAGGCAACAAGAGGTGTTTGATCTCATCCGTGATCACATCAGC CAGACAGGTATGCCGCCGACGCGTGCGGAAATCGCGCAGCGTTTGGGGTT | SEQ ID NO: 510 | R | up | |
| Ec_cip | b4044 | 509-608 | TACTCGGCGTGCAATATGCCCGTGCGCCAGTAATTTTGTTAGTGGTCGGC AATATCCTCAACATTGTGCTGGATGTCTGGCTGGTGATGGGGCTGCATAT | SEQ ID NO: 511 | R | up | |
| Ec_cip | b4058 | 64-163 | CCCCGCGACAAGCTCATTGTCGTGACCGGGCTTTCGGGTTCTGGCAAATC CTCGCTCGCTTTCGACACCTTATATGCCGAAGGGCAGCGCCGTTACGTTG | SEQ ID NO: 512 | R | up | |
| Ec_cip | b4060 | 100-199 | ATGGCTACCCTCACCACTGGCGTGGTTCTTCTTCGCTGGCAACTTCTTAG TGCCGTAATGATGTTTCTGGCCAGCACACTCAACATCCGTTTTCGTCGGT | SEQ ID NO: 513 | R | up | |
| Ec_cip | b4062 | 171-270 | CGCCTGTTACTGGCCGCCGTTGAGTTGCGCACCACCGAGCGTCCGATTTT TGATATCGCAATGGACCTGGGTTATGTCTCGCAGCAGACCTTCTCCCGCG | SEQ ID NO: 514 | R | up | |
| Ec_cip | b4105 | 374-473 | AACAAAGATAGTCCGATCAACAACCTGAACGATCTGCTGGCGAAGCGGAA AGATCTCACCTTCGGCAATGGCGATCCTAACTCCACCTCNNNNNNNNNNN | SEQ ID NO: 515 | R | up | |
| Ec_cip | b4106 | 610-709 | ACCGTGGTCGTCACGCTGCATCAGGTGGATTACGCCCTGCGCTACTGCGA ACGCATCGTCGCCCTGCGCCAGGGGCACGTCTTCTACGACGGCAGCAGCC | SEQ ID NO: 516 | R | up | |
| Ec_cip | b4142 | 24-123 | TTGCATGATCGCGTGATCGTCAAGCGTAAAGAAGTTGAAACTAAATCTGC TGGCGGCATCGTTCTGACCGGCTCTGCAGCGGCTAAATCCACCCGCGGCG | SEQ ID NO: 517 | R | up | |
| Ec_cip | b4143 | 490-589 | AGCGATGGACAAAGTCGGTAAAGAAGGCGTTATCACCGTTGAAGACGGTA CCGGTCTGCAGGACGAACTGGACGTGGTTGAAGGTATGCAGTTCGACCGT | SEQ ID NO: 518 | R | up | |
| Ec_cip | b4166 | 397-496 | AAACTCGGCTATGTTAGCCGTTATGCGCTGGGCCGTGACTATCACAAACT TCTGCGCAACCGACTCAAAAAGCTGGGCGAGATGATTCAGCAACATTGTG | SEQ ID NO: 519 | R | up | |
| Ec_cip | b4242 | 808-907 | CGTGTTAGTGAGCAGGAAAGCGAGCCGAATGCCTTTCAGCAAGGGATCAG CCGCGTCAGTATGCTGCTGATTCGCTTTATGCTGGTGATGGCTCCGGTGG | SEQ ID NO: 520 | R | up | |
| Ec_gent GeneID = NC_ 000913 | b1272 | 523-622 | GCTGCCAGCGGCGGTTACATGATGGCCTGTGTGGCGGACAAAATTGTTTC CGCACCGTTTGCTATTGTGGGTTCCATTGGGGTGGTGGCGCAAATGCCCA | SEQ ID NO: 521 | C | | x |
| Ec_gent | b1719 | 481-580 | ACGAAAACATCGCCCATGATGACAAGCCAGGTCTGTACTTCCATGAAGAA TATGTCGATATGTGCCGCGGTCCGCACGTACCGAACATGCGTTTCTGCCA | SEQ ID NO: 522 | C | | x |
| Ec_gent | b1914 | 392-491 | ACAAATGGCGTTAAGCCAGATCGAACCAGAAAAAACAGAAAGCCCATTTG CCAGTTTGTCTGAACGTGAATTGCAGATTATGCTGATGATCACCAAGGGC | SEQ ID NO: 523 | C | | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_gent | b2821 | 743-842 | CGGACACCTTTGGTCGCGTGCCGAACAAAGAGAGCAAAAAACCGGAAATC ACCGTGCCGGTAGTCACCGACGCGCAAAAGGGCATTATCATTCATTACGT | SEQ ID NO: 524 | C | | x |
| Ec_gent | b2830 | 223-322 | TTGCGCTACAAATTACCGAAACGTTTGGTGCGTTGGGACACGAAGCCGGT TTGTATCGGCCAAAAACAAAAATGGTTTCTCTTGCAGCTGGTGAGCGGCG | SEQ ID NO: 525 | C | | x |
| Ec_gent | b2910 | 23-122 | TCCAAATTTTTGGCCGTTCACTGCGTGTGAACTGCCCGCCTGACCAAAGG GATGCGTTGAATCAGGCAGCGGACGATCTGAACCAACGGTTGCAAGATCT | SEQ ID NO: 526 | C | | x |
| Ec_gent | b3040 | 300-399 | CATGCGCATCCGCAGGATTTAATGCAAAAATCGGTGCAGCCGTTGCCAAA ATCGATCAAGCGCACAGCCATTCTGCTCACTCTCGGCATCAGTCTGCATA | SEQ ID NO: 527 | C | | x |
| Ec_gent | b3389 | 102-201 | CGAGCAGGTCATGTTGGTCACCAACGAAACCCTGGCTCCTCTGTATCTCG ATAAGGTCCGCGGCGTACTTGAACAGGCGGGTGTTAACGTCGATAGCGTT | SEQ ID NO: 528 | C | | |
| Ec_gent | b3929 | 443-542 | GGTTGGTGCCGCTGGCGAAGGCATTGGCGAAAGCGATGTCCGCGTCAATT TTGGCGGTGTCACCTTCTTCTCCGGCGACCATCTTNNNTATGCCGACAAT | SEQ ID NO: 529 | C | | |
| Ec_gent | b4041 | 1507-1606 | ACTGGCGTGAATCTATCGATCCCATCGAAGCGGTGCGTCCGGCCTGGTTA ACGCCGACGGTCAATAATATTGCTGCCGATCTGATGGTACGCATTAACAA | SEQ ID NO: 530 | C | | x |
| Ec_gent | b4059 | 171-270 | CGTTGTGCTGTTCGGCAAACTGGCAGAAGTGGCCAGCGAATATCTGCGTA AAGGTTCTCAGGTTTATATCGAAGGTCAGCTGCGTACCCGTAAATGGACC | SEQ ID NO: 531 | C | | |
| Ec_gent | b4169 | 448-547 | GCCTGCGGTTGTCGCACCGCGCGTCAGCGAACCGGCGCGCAATCCGTTTA AAACGGAAAGTAACCGCACTACGGGTGTTATCAGCAGTAATACGGTAACG | SEQ ID NO: 532 | C | | |
| Ec_gent | b4174 | 729-828 | GAAGAAGTAAAAGCGGCGTTTGACGATGCGATTGCCGCGCGTGAAAACGA ACAGCAATACATTCGTGAAGCAGAAGCGTATACCAACGAAGTTCAGCCGC | SEQ ID NO: 533 | C | | |
| Ec_gent | b4175 | 175-274 | ATTGAAACGGTGAAAATGCTCGACGCACGTATTCAGACCATGGACAACCA GGCCGACCGCTTTGTGACCAAAGAGAAGAAAGACCTGATCGTCGACTCTT | SEQ ID NO: 534 | C | | x |
| Ec_gent | b4220 | 495-594 | CGCAGCTGGGCATTGCGCTCGGCCTGCATAAAGCCTTCTGGGATATTGAT TATAACAGTGGCGAACGTTACCGCTTTGGGCATGTGACCTTTGAAGGATC | SEQ ID NO: 535 | C | | x |
| Ec_gent | b4255 | 100-199 | ACACCATCGAACACCATCTTTCCGCAGACGATCTGGAAACCCTGGAAAAA GCAGCAGTTGAAGCGTTTAAACTCGGTTACGAAGTGACCGATCCAGAAGA | SEQ ID NO: 536 | C | | x |
| Ec_gent | b0085 | 379-478 | TGGCGCAGTGGAGCCAACTGCTTGGCGAAACCAGCGCGGTAATGGGCACC GTTGGTAACGGCCTGCTGGGGAAAGTGATCCCGACAGAAAATACCACCGG | SEQ ID NO: 537 | R | dn | |
| Ec_gent | b0086 | 362-461 | TTTTAAGCCAGTGCGGCAACACGCTTTATACGGCAGGCAATCTCAACAAC GACATCGGTGTACCGATGACGCTGTTGCGCTTAACGCCGGAATACGATTA | SEQ ID NO: 538 | R | dn | |
| Ec_gent | b0087 | 860-959 | CCTGCTGGTGATTATGGGGGGCGTGTTCGTGGTAGAAACGCTTTCTGTCA TCCTGCAGGTCGGCTCCTTTAAACTGCGCGGACAACGTATTTTCCGCATG | SEQ ID NO: 539 | R | dn | |
| Ec_gent | b0428 | 254-353 | GGACGAAGAATCGGGTGCTGGTTAAAGGCCTGATCTCTCCTGCTGTCTCG CTGGTGTACGCCACCTTGCTGGGTATTGCTGGCTTTATGCTGCTGTGGTT | SEQ ID NO: 540 | R | dn | |
| Ec_gent | b0429 | 156-255 | GATCATTCTGACGGTGATTCCGTTCTGGATGGTGATGACAGGGGCTGCCT CTCCGGCCGTAATTCTGGGAACAATCCTGGCAATGGCAGTGGTACAGGTT | SEQ ID NO: 541 | R | dn | |
| Ec_gent | b0430 | 163-262 | GCAGGCGGCCCGACAGGTAAGGACATTTTCGAACTGCCGTTCGTTCTGGT TGAAACTTTCTTGCTGTTGTTCAGCTCCATCACCTACGGCATGGCGGCTA | SEQ ID NO: 542 | R | dn | |
| Ec_gent | b0733 | 1104-1203 | TCTCCCGCTATGCGCCGGATATGAATCATGTCACAGCCGCACAGTACCAG GCGGCGATGCGTGGCGCGATACCTCAGGTTGCGCCGGTATTCTGGAGTTT | SEQ ID NO: 543 | R | dn | |
| Ec_gent | b0734 | 291-390 | TCTTCCGTCCGGTCGGTTTTGACTACCGCTCCAAGATTGAAGAAACCCGC TGGCGTAACATGTGGGACTGGGGCATCTTCATTGGTAGCTTCGTTCCGCC | SEQ ID NO: 544 | R | dn | |
| Ec_gent | b0735 | 95-194 | TGTTTTGGGACCCATCTCGTTTTGCCGCGAAGACCAGTGAACTGGAAATC TGGCATGGTTTATTGCTGATGTGGGCCGTCTGTGCTGGTGTGATTCACGG | SEQ ID NO: 545 | R | dn | |
| Ec_gent | b0794 | 563-662 | TGGCGGGCGAAGGGATGTTAATCCTCTGGAGTACCTCGTATCTCGACGAA GCCGAGCAGTGCCGTGACGTGTTACTGATGAACGAAGGCGAGTTGCTGTA | SEQ ID NO: 546 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Ec_gent | b1049 | 748-847 | CCGGAGCATCGCACGGCGTTGATCATGCCTATCTGTAACGAAGACGTGAA CCGTGTTTTTGCTGGCCTGCGTGCAACGTGGGAATCAGTAAAAGCCACCG | SEQ ID NO: 547 | R | dn | |
| Ec_gent | b1244 | 397-496 | GCTGGCAATGACCGGGGTTGTTATCCCCAGTTTTGTGGTTGCGCCATTAT TAGTCATGATATTTGCGATCATTTTGCATTGGCTGCCGGGCGGTGGCTGG | SEQ ID NO: 548 | R | dn | |
| Ec_gent | b1378 | 1056-1155 | GAAACTCTGCCCCGTGTCATTGGTGGGCGCTATGGTCTTTCATCCAAAGA ATTTGGCCCGGACTGTGTACTGGCGGTATTTGCCGAGCTCAACGCGGCTA | SEQ ID NO: 549 | R | dn | |
| Ec_gent | b2255 | 944-1043 | CCGGGTACTCATCCTCGGGGTGAATGGCTTTATTGGCAACCATCTGACAG AACGCCTGCTGCGCGAAGATCATTATGAAGTTTACGGTCTGGATATTGGC | SEQ ID NO: 550 | R | dn | |
| Ec_gent | b2276 | 182-281 | TGGACGTTACGCCGCTGATGCGCGTTGATGGTTTCGCCATGCTTTACACC GGGCTGGTATTGTTGGCGAGCCTCGCCACCTGTACTTTCGCCTACCCGTG | SEQ ID NO: 551 | R | dn | |
| Ec_gent | b2277 | 421-520 | CTTCTGGGAAATGATGCTGGTGCCGATGTACTTCCTGATCGCACTGTGGG GGCATAAAGCCTCTGACGGTAAAACGCGTATCACGGCGGCAACCAAGTTC | SEQ ID NO: 552 | R | dn | |
| Ec_gent | b2278 | 904-1003 | GACATCAAACGTGTTCTCGCTTACTCTACCATGAGCCAGATTGGCTACAT GTTCCTCGCGCTTGGCGTGCAGGCATGGGATGCGGCGATTTTCCACTTGA | SEQ ID NO: 553 | R | dn | |
| Ec_gent | b2279 | 178-277 | GTGATGTACATTCTCGCCATCAGCCTCGCGGCGGCAGAAGCGAGTATCGG CCTTGCGCTGCTGCTGCAACTTCACCGTCGTCGCCAGAACCTGAACATCG | SEQ ID NO: 554 | R | dn | |
| Ec_gent | b2280 | 311-410 | TGGTGGTGATTGTTTACGCCATCCTCGGTGTTAACGATCAGGGTATCGAC GGTACGCCAATCAGTGCTAAAGCAGTGGGTATTACGCTGTTCGGGCCTTA | SEQ ID NO: 555 | R | dn | |
| Ec_gent | b2281 | 47-146 | GTATCTGGATGATCGGCCTGCACGCGTTCGCCAAACGCGAAACGCGAATG TACCCGGAAGAGCCGGTCTATCTGCCGCCCCGTTATCGTGGTCGTATCGT | SEQ ID NO: 556 | R | dn | |
| Ec_gent | b2282 | 723-822 | ATCGGGATTGTGACCATCTCTGCATTGATGGTGACGCTGTTCTTCGGTGG CTGGCAAGGCCCGTTGTTACCGCCATTCATCTGGTTCGCGCTGAAAACCG | SEQ ID NO: 557 | R | dn | |
| Ec_gent | b2283 | 160-259 | CAATACCAAAACGCGGAAGACACGCGTGGTCGCCTGGTGATGTCCTGTAT GACACCGGCTTCCGATGGCACCTTTATTTCCATTGACGACGAAGAAGCGA | SEQ ID NO: 558 | R | dn | |
| Ec_gent | b2284 | 655-754 | GAAACCCTGTGTAACGTTCCGGCGATCCTCGCTAACGGCGTGGAGTGGTA TCAGAACATCTCGAAAAGTAAAGATGCTGGCACCAAGCTGATGGGCTTCT | SEQ ID NO: 559 | R | dn | |
| Ec_gent | b2285 | 32-131 | CTTTTGAGCTGAGTGCGGCAGAGCGTGAAGCGATTGAGCACGAGATGCAC CACTACGAAGACCCGCGTGCGGCGTCCATTGAAGCGCTGAAAATCGTTCA | SEQ ID NO: 560 | R | dn | |
| Ec_gent | b2286 | 192-291 | AAAGAAACTGCCGAAACCTTACGTCATGCTGTTTGACTTACACGGCATGG ACGAACGTCTGCGCACACACCGCGAAGGGTTACCTGCCGCGGATTTTTCC | SEQ ID NO: 561 | R | dn | |
| Ec_gent | b2726 | 31-130 | TGCCAACGGGCACTGGAATTGATCGAACAGCAGGCCGCAAAACACGGCGC AAAACGCGTAACTGGGGTCTGGCTCAAAATTGGCGCATTTTCTTGTGTCG | SEQ ID NO: 562 | R | dn | |
| Ec_gent | b2727 | 1-100 | ATGTGTACAACATGCGGTTGCGGTGAAGGCAACCTGTATATCGAGGGTGA TGAACATAACCCTCATTCCGCGTTTCGTAGCGCGCCATTTGCCCCGGCGG | SEQ ID NO: 563 | R | dn | |
| Ec_gent | b2729 | 725-824 | AAATAGCGGCCCACAGCAAGGTAGAGAATCAGTATCGTCGGGTGGTACCG GATGCCGGTAACCTGCTGGCGCAACAGGCGATTGCCGATGTGTTCTGTGT | SEQ ID NO: 564 | R | dn | |
| Ec_gent | b2957 | 72-171 | CAATATCACCATTTTAGCAACCGGCGGGACCATTGCCGGTGGTGGTGACT CCGCAACCAAATCTAACTACACAGCGGGTAAAGTTGGCGTAGAAAATCTG | SEQ ID NO: 565 | R | dn | |
| Ec_gent | b2996 | 917-1016 | GGTTCTGGTACTGACGGGTGTGCCTTATGAAAATCTCGACCTGCCGAAAC TGGACGATCTTTCTACCGGTGCGCGTTCCGAANNNNNNNNNNNNNNNNNN | SEQ ID NO: 566 | R | dn | |
| Ec_gent | b3118 | 187-286 | TAACACCTGCCGGTCAATTGTTACTCTCCCGTTCCGAATCCATTACCCGT GAAATGAAAAATATGGTTAATGAGATAAGCGGTATGTCTTCTGAGGCGGT | SEQ ID NO: 567 | R | dn | |
| Ec_gent | b3745 | 435-534 | CAGCTATTAGAAGAAGAACGCGAACAACTGTTGAGTGAAGTTCAGGAACG CATGACGCTGAGCGGACAACTTGAACCGATTCTCGCAGATAACAATACCG | SEQ ID NO: 568 | R | dn | |
| Ec_gent | b3891 | 371-470 | CAGTGATTGAGAATCTGGAGAAGGCATCGACTCAGGAGCTGGAAGATATG GCCAGCGCACTGTTTGCCTCTGATTTCTCGTCCGTCAGCAGCGATAAAGC | SEQ ID NO: 569 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_gent | b3892 | 287-386 | TCGTCAACGAGGAAGTAGGTGACACCGGGCGTTATAACTTCGGTCAGAAA TGCGTTTTCTGGGCGGCGATTATTTTCCTGGTTCTGCTGCTGGTGAGCGG | SEQ ID NO: 570 | R | dn | |
| Ec_gent | b4139 | 503-602 | TGGGTCACCAGAAAGGTGAATATCAGTACCTGAACCCGAACGACCATGTT AACAAATGTCAGTCCACTAACGACGCCTACCCGACCGGTTTCCGTATCGC | SEQ ID NO: 571 | R | dn | |
| Ec_gent | b4152 | 140-239 | TGTTTGCCCTGAAAAATGGCCCGGAAGCCTGGGCGGGATTCGTCGACTTT TTACAAAACCCGGTTATCGTGATCATTAACCTGATCACTCTGGCGGCAGC | SEQ ID NO: 572 | R | dn | |
| Ec_gent | b4153 | 169-268 | TCCTGCCGTATGGCGATTTGTGGTTCCTGCGGCATGATGGTTAACAACGT GCCAAAACTGGCATGTAAAACCTTCCTGCGTGATTACACCGACGGTATGA | SEQ ID NO: 573 | R | dn | |
| Ec_gent | b4154 | 959-1058 | GCGAGAAAAAACTGCATGAACGTCTGCCGTTCATCTGCGAACTGGCGAAA GCGTACGTTGGCGTCGATCCGGTTAAAGAACCGATTCCGGTACGTCCGAC | SEQ ID NO: 574 | R | dn | |
| Ec_gent | b0014 | 208-307 | ACGCCTGATTGGCCGCCGCTTCCAGGACGAAGAAGTACAGCGTGATGTTT CCATCATGCCGTTCAAAATTATTGCTGCTGATAACGGCGACGCATGGGTC | SEQ ID NO: 575 | R | up | |
| Ec_gent | b0015 | 289-388 | TTTCGGCGATATTTTTGGCGGCGGACGTGGTCGTCAACGTGCGGCGCGCG GTGCTGATTTACGCTATAACATGGAGCTCACCCTCGAAGAAGCTGTACGT | SEQ ID NO: 576 | R | up | |
| Ec_gent | b0019 | 464-563 | TTGATGGCTCTGGCTATTATCGACGATCTTGGGGCCATCATTATCATCGC ATTGTTCTACACTAATGACTTATCGATGGCCTCTCTTGGCGTCGCGGCTG | SEQ ID NO: 577 | R | up | |
| Ec_gent | b0161 | 769-868 | CGGCGGCAACATCGGTATCGGTTTTGCTATCCCGAGCAACATGGTGAAAA ACCTGACCTCGCAGATGGTGGAATACGGCCAGGTGAAACGCGGTGAGCTG | SEQ ID NO: 578 | R | up | |
| Ec_gent | b0199 | 787-886 | CTGACTGCGTGCCGATGCTGCGTCTGGAGTTTACCGGTCAATCGGTCGAT GCCCCACTGCTTTCTGAAACCGCGCGTCGTTTCAACGTCAACAACAACAT | SEQ ID NO: 579 | R | up | |
| Ec_gent | b0313 | 137-236 | GCGTTTCTACGGGGATCATCAGCCACTATTTCAGGGACAAAAATGGTCTG CTGGAAGCAACCATGCGCGATATCACCAGTCAGCTGCGTGACGCGGTTTT | SEQ ID NO: 580 | R | up | |
| Ec_gent | b0460 | 298-397 | TGCCAGACAATTGACACGCTGGAGCGTGTTATCGAGAAAAATAAATACGA ATTATCAGATAATGAACTGGCGGTATTTTACTCAGCCGCAGATCACCGCC | SEQ ID NO: 581 | R | up | |
| Ec_gent | b0631 | 67-166 | GCGTTACCTGAGCTGGTTGATCAGGTGGTTGAAGTGGTACAGCGCCATGC GCCAGGTGACTACACCCCAACGGTAAAACCAAGCAGCAAAGGCAACTACC | SEQ ID NO: 582 | R | up | |
| Ec_gent | b0841 | 233-332 | TCCGCACGACCGACCCTTTGTCGAAAATATCGGCTATAACTTCCTGCATC ATGCGGCGGATGACTCATTCCCAAGCGATCACGGTACGGTGATTTTCACC | SEQ ID NO: 583 | R | up | |
| Ec_gent | b1113 | 737-836 | GTCTGGCGGCCTATGGCGGCGTTTATTTGCTTCACGGTACGAACGCCGAT TTCGGCATTGGCATGCGGGTAAGTTCTGGCTGTATTCGTCTGCGGGATGA | SEQ ID NO: 584 | R | up | |
| Ec_gent | b1304 | 368-467 | CGAGCTGGAAAACAAATTGAGCGAAACACGCGCTCGCCAGCAGGCATTGA TGTTACGCCATCAGGCGGCAAACTCGTCGCGCGATGTGCGTCGTCAGCTG | SEQ ID NO: 585 | R | up | |
| Ec_gent | b1305 | 72-171 | GCATTACAGCAATCGTTCTGGTCGCAGTGAATTGTCGCAAAGTGAGCAGC AGCGATTAGCGCAACTGGCTGATGAAGCAAAACGGATGCGCGAACGTATT | SEQ ID NO: 586 | R | up | |
| Ec_gent | b1306 | 91-190 | GATGTACCGGTAAAACTGGTGCGTATCCTGGTGGTGCTGTCGATTTTCTT CGGTCTGGCGCTGTTTACCCTGGTTGCTTACATCATTTTGTCATTTGCGC | SEQ ID NO: 587 | R | up | |
| Ec_gent | b1436 | 58-157 | CTCATGGCAGGGCACAAAGGACATGAATTTGTGTGGGTAAAGAATGTGGA TCATCAGCTGCGTCATGAAGCGGACAGCGATGAATTGCGTGCTGTGGCGG | SEQ ID NO: 588 | R | up | |
| Ec_gent | b1530 | 73-172 | AAAGATCGTCTGCTTAACGAGTATCTGTCTCCGCTGGATATTACCGCGGC ACAGTTTAAGGTGCTCTGCTCTATCCGCTGCGCGGCGTGTATTACTCCGG | SEQ ID NO: 589 | R | up | |
| Ec_gent | b1531 | 112-211 | GGTTACTCCAAATGGCACCTGCAACGGATGTTTAAAAAAGAAACCGGTCA TTCATTAGGCCAATACATCCGCAGCCGTAAGATGACGGAAATCGCGCAAA | SEQ ID NO: 590 | R | up | |
| Ec_gent | b1599 | 127-226 | CGGCGGTGCTGGCTGCCTTTAGTGCGCTTTCTCAGGCCGTTAAAGGGATC GACTTGTCTGTCGCTTATGCATTGTGGGGGGGGTTTGGTATTGCCGCCAC | SEQ ID NO: 591 | R | up | |
| Ec_gent | b1728 | 40-139 | TCTATTGCTTGTGCGGTATTTGCCAAAAATGCCGAGCTGACGCCCGTGCT GGCACAGGGTGACTGGTGGCATATTGTCCCTTCCGCAATCCTGACGTGTT | SEQ ID NO: 592 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ec_gent | b1829 | 27-126 | AACGAACCTGGCCGTAATGGTCGTTTTCGGGCTGGTACTGAGCCTGACAG GGATACAGTCGAGCAGCGTTCAGGGGCTGATGATCATGGCCTTGCTGTTC | SEQ ID NO: 593 | R | up | |
| Ec_gent | b2106 | 505-604 | AGGATGCCCATGCACGAGCCCATGCCAATGACATTAAACGACGCTTTGAT GGTAGAGAGGTCACCAACTGGCAAATTTTGCTATTTGGCTTAACCGGTGG | SEQ ID NO: 594 | R | up | |
| Ec_gent | b2119 | 114-213 | ATACGCCGATGAACTGGCAAAATTAAAACAAAATGATAACGCACCTTGCC CGCCCGGTTGGCAGTTAAGTTTGCCTGCGGCCCGTGCTTTTATCCTTGGC | SEQ ID NO: 595 | R | up | |
| Ec_gent | b2181 | 108-207 | CGGTGACAACAGCCTGGTGGCGCTTAAATTGCTTAGCCCGGATGGTGATA ATGCATGGTCGGTGATGTATAAACTAAGCCAGGCGTTAAGCGACATCGAA | SEQ ID NO: 596 | R | up | |
| Ec_gent | b2392 | 669-768 | ATGGCGGTTCGCGTCAACAACGTTATTCCGCCACCAAATGGGATGTGGCT ATCGCCATGACGATTGCCGGTTTTGTCAATCTGGCGATGATGGCTACAGC | SEQ ID NO: 597 | R | up | |
| Ec_gent | b2531 | 137-236 | TTTCCCGTCTGCGTAAAAATGGTCTGGTTTCCAGCGTACGTGGACCAGGC GGTGGTTATCTGTTAGGCAAAGATGCCAGCAGCATCGCCGTTGGCGAAGT | SEQ ID NO: 598 | R | up | |
| Ec_gent | b2582 | 110-209 | TGATTAATGCGACCGGTGAAACGCTCGACAAATTGCTGAAGGATGATCTA CCTGTGGTGATCGACTTCTGGGCACCGTGGTGCGGCCCCTGCCGTAATTT | SEQ ID NO: 599 | R | up | |
| Ec_gent | b2667 | 113-212 | GCACCAGCGCGGGAGAGCTGACGCGCATTACCGGACTGAGTGCCTCTGCG ACATCACAGCATCTCGCTCGTATGCGGGACGAAGGGCTTATCGACAGCCA | SEQ ID NO: 600 | R | up | |
| Ec_gent | b2980 | 427-526 | GATAACCCGCTGTTATGAAAAAATGCTCGCCGCCAGTGAGAACAACAAAG AGATTTCGCTGATCGAACATGCGCAGTTGGATCACGCTTTCCATCTCGCC | SEQ ID NO: 601 | R | up | |
| Ec_gent | b3184 | 20-119 | TTGGCATTCTTTTGGCGCTCACCACAGCAATTTGCTGGGGGGCGTTGCCA ATCGCAATGAAGCAGGTGCTGGAGGTGATGGAACCTCCGACAATCGTGTT | SEQ ID NO: 602 | R | up | |
| Ec_gent | b3343 | 1-100 | ATGCTGCACACATTACATCGTTCACCCTGGCTGACGGATTTTGCTGCGCT GCTGCGTCTGCTCAGTGAAGGAGACGAACTGCTATTATTGCAAGATGGCG | SEQ ID NO: 603 | R | up | |
| Ec_gent | b3399 | 178-277 | GTTACGCCACAGGAAGCGATGGAATATATGCGCCAGCAATATCACGACGT ACAGCATACGCTAAACTGGTACTGTCTTGATTACTGGAGTGAGCAACTGG | SEQ ID NO: 604 | R | up | |
| Ec_gent | b3400 | 147-246 | GAGCTGAATGCCACGCTCACTCTGCGCCAGGGAAATGACGAACGCACGGT GATTGTAAAGGCGATTACTGAACAGCGTCGCCCCGCCAGCGAGGCAGCCT | SEQ ID NO: 605 | R | up | |
| Ec_gent | b3401 | 390-489 | GTTGGTCTGGAAGGTGATACCCTGGCGGCCTGCCTGGAAGATTACTTTAT GCGTTCTGAACAGCTGCCGACGCGCCTGTTTATTCGCACCGGCGACGTAG | SEQ ID NO: 606 | R | up | |
| Ec_gent | b3461 | 130-229 | CATGGCGATCTGGAAGCAGCTAAAACGCTGATCCTGTCTCACCTGCGGTT TGTTGTTCATATTGCTCGTAATTATGCGGGCTATGGCCTGCCACAGGCGG | SEQ ID NO: 607 | R | up | |
| Ec_gent | b3635 | 113-212 | CAGAAGAGATCTACCGTTTAAGCGACCAACCAGTGCTTAGCGTGCAGCGG CGGGCTAAATATCTGCTGCTGGAGCTGCCTGAGGGCTGGATTATCATTCA | SEQ ID NO: 608 | R | up | |
| Ec_gent | b3686 | 100-199 | TTCCCGCCGTACAACATTGAGAAAAGCGACGATAACCACTACCGCATTAC CCTTGCGCTGGCAGGTTTCCGTCAGGAAGATTTAGAGATTCAACTGGAAG | SEQ ID NO: 609 | R | up | |
| Ec_gent | b3687 | 101-200 | GCGGCTACCCTCCGTATAACGTTGAACTGGTAGACGAAAACCATTACCGC ATTGCTATCGCTGTGGCTGGTTTTGCTGAGAGCGAACTGGAAATTACCGC | SEQ ID NO: 610 | R | up | |
| Ec_gent | b3743 | 149-248 | GGATCATTACCGGGGCGCGTATTGATGTCAGCCCGAAGCAGCTCGGTTAT GACGTAGGCTGCTTTATCGGCATTATATTAAAGAGCGCCAAAGACTACCC | SEQ ID NO: 611 | R | up | |
| Ec_gent | b3820 | 241-340 | GTGTGCGTGGGAAGTACCTTAACCCGCCACGAAACCATCAGTGAAGATGA ACTACGCCAGCGGCTATCGCGGATGGGGACCATTGATCTTCGCGTTGATT | SEQ ID NO: 612 | R | up | |
| Ec_gent | b3828 | 62-161 | CCGCTGCGGCGACGTTGCATCAGACGCAATCCGCCCTGTCTCACCAGTTT AGCGATCTGGAACAACGCCTTGGCTTCCGGCTATTTGTGCGTAAGAGCCA | SEQ ID NO: 613 | R | up | |
| Ec_gent | b3932 | 133-232 | GCGGGCTTTGCGGGCGGTACTGCGGATGCTTTTACGCTGTTCGAACTGTT TGAACGTAAACTGGAAATGCATCAGGGCCATCTGGTCAAAGCCGCCGTTG | SEQ ID NO: 614 | R | up | |
| Ec_gent | b3941 | 125-224 | GGAACTCCATCGATCGCCTTAGCAGCCTGAAACCGAAGTTTGTATCGGTG ACCTATGGCGCGAACTCCGGCGAGCGCGACCGTACGCACAGCATTATTAA | SEQ ID NO: 615 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Ec_gent | b4060 | 100-199 | ATGGCTACCCTCACCACTGGCGTGGTTCTTCTTCGCTGGCAACTTCTTAG TGCCGTAATGATGTTTCTGGCCAGCACACTCAACATCCGTTTTCGTCGGT | SEQ ID NO: 616 | R | up | |
| Ec_gent | b4062 | 171-270 | CGCCTGTTACTGGCCGCCGTTGAGTTGCGCACCACCGAGCGTCCGATTTT TGATATCGCAATGGACCTGGGTTATGTCTCGCAGCAGACCTTCTCCCGCG | SEQ ID NO: 617 | R | up | |
| Ec_gent | b4242 | 808-907 | CGTGTTAGTGAGCAGGAAAGCGAGCCGAATGCCTTTCAGCAAGGGATCAG CCGCGTCAGTATGCTGCTGATTCGCTTTATGCTGGTGATGGCTCCGGTGG | SEQ ID NO: 618 | R | up | |
| Ec_gent | b4321 | 100-199 | GCGGCGCTGTCCGTCGGGATGCTGGCGGGCATGGATTTGATGTCGCTGCT GCACACCATGAAAGCGGGCTTCGGCAACACGCTGGGGGAACTGGCTATCA | SEQ ID NO: 619 | R | up | |
| Ec_gent | b4322 | 867-966 | GGTCCGCGTATTTACTTCACCCATCTGCGCTCCACCATGCGTGAAGATAA CCCGAAAACCTTCCACGAAGCGGCGCACCTGAACGGTGACGTTGATATGT | SEQ ID NO: 620 | R | up | |
| Ec_gent | b4484 | 128-227 | GAGCCATATGTTCGACGGCATAAGTTTAACCGAACATCAGCGTCAGCAGA TGCGAGATCTTATGCAACAGGCCCGGCACGAACAGCCTCCTGTTAATGTT | SEQ ID NO: 621 | R | up | |
| Ec_gent | b4550 | 6-105 | CCGATATCAGCATACTAAAGGGCAGATAAAGGATAATGCGATAGAAGCAT TACTACATGATCCCTTATTCCGACAGCGCGTAGAGAAAAATAAGAAGGGG | SEQ ID NO: 622 | R | up | |
| Ab_mero GeneID = NC_ 021726 (alt GeneID = NC_ 017847, used for FIG. 6 heatmap) | BJAB07104_ 00229 (ABTJ_ 03609) | 1591-1690 | GGACCAATATTTAAGTCATGCTGTCGGGAAAACCAATCAGCGAGTTTACT TCCTTGATGAAACAGGGCGCAGCTATGCCTTGCCAATTAGTAACTTACCT | SEQ ID NO: 623 | C | | x |
| Ab_mero | BJAB07104_ 00412 (ABTJ_ 03419) | 877-976 | GATTTTGCACTATAACCCTTCGCAAGAATATTGGGCCGATAGTGTCGACC CACTCTGGAAACAGCGCTATGACTTAGGGGTAAAAGAGCGTTTTATAGCG | SEQ ID NO: 624 | C | | x |
| Ab_mero | BJAB07104_ 00560 (ABTJ_ 03270) | 163-262 | ACGAATAAGGCAGATCCATTACGTTTACAACTTGATGCTAGCGAAGGTGT TGTTTTTACCCTTGATCCTAAAGGTGAAGTTGCTGCATACCGTGGTAAAC | SEQ ID NO: 625 | C | | x |
| Ab_mero | BJAB07104_ 01090 (ABTJ_ 02819) | 326-425 | TCCTGACACGGTTACTTGATGAAGTGCATCAACAATTACCGAAGATTCAG TTGCATTTACATGAAGCTCAAAGTGAGAAGATTGTAGAGCGCCTAGAACA | SEQ ID NO: 626 | C | | x |
| Ab_mero | BJAB07104_ 01651 | 58-157 | GCTAATGCAGCTGGTTATGGGGTAATTGATCTAGCTAAAGTTGTTGAAAG TAGTACTTATTTGAAACAGCAAAATGCAAGCTTAAACCAGTCAGTGAAAC | SEQ ID NO: 627 | C | | |
| Ab_mero | BJAB07104_ 01716 (ABTJ_ 01686) | 419-518 | TAAGCAAGCTCAAGTCATTGGTAATCCGGGTTGTTACCCAACGACTGTTC AACTGGGCTTGGCTCCACTTTTAAAATCAGCACAAGCATTGATTGAAACA | SEQ ID NO: 628 | C | | x |
| Ab_mero | BJAB07104_ 02033 | 221-320 | CAGCTGCGGTGAATGATGCTGTGCGTCAAGCTGAAGTAGTTTCTGAAGAA AAAATGCAAAAAGCTAACTCTGGTATGGGTTTACCTCCTGGTTTAGCAGG | SEQ ID NO: 629 | C | | |
| Ab_mero | BJAB07104_ 02399 | 139-238 | GTAGATGTTAATGAAGTGGCTGCGGAAAGCCAGCGAAAAGCAGCATTAAG TGAACATGACAACTTAGAACCGGGGTCAAATTTATGGATTGCTCGTCAGG | SEQ ID NO: 630 | C | | |
| Ab_mero | BJAB07104_ 03654 (ABTJ_ 00121) | 896-995 | TACCACGTAATCTTAAACTTTCGGCTGAAGATGTTTGGGATGGCGTGAAC TATATTTTATCGCTTAAGTTCCAAGAACCACAGTTCTCTGGTCAAACCAA | SEQ ID NO: 631 | C | | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_mero | BJAB07104_ 03685 (ABTJ_ 00092) | 148-247 | GACCAGTCAACTCGTTGCAGACAGCTTATCTGAGCTTGAACCTGCCAATA CGGTCTCTTTAGCTCTGATTGCCAATCGCTATGCGACCAATCCAAGTGTG | SEQ ID NO: 632 | C | | x |
| Ab_mero | BJAB07104_ 03755 (ABTJ_ 00027) | 466-565 | TTGTGTCTGGCGGACCAATGGAAGCAGGTAAGGTTAAATTCCGCGGTGAT GAAAAAGCAATTGACCTTGTAGATGCTATGGTTGTTGCAGCTGATGACAG | SEQ ID NO: 633 | C | | x |
| Ab_mero | BJAB07104_ 00185 | 361-460 | CTCATGAACTTAATGGACTTGATCCCAGTTGACTGGATTCCTCAAGTTGC TGCATTTGTGGGTGCTAACGTATTTGGTATGGACCCTCACCACGTTTACT | SEQ ID NO: 634 | R | dn | |
| Ab_mero | BJAB07104_ 00186 (ABTJ_ 03655) | 105-204 | AGAAGCTGTTGCTCGTCAACCAGAATTAGCTCCACAACTTCAAACTCGTA TGTTCTTAATCGCGGGTCTTCTTGATGCTGTGCCTATGATCGGTGTTGGT | SEQ ID NO: 635 | R | dn | x |
| Ab_mero | BJAB07104_ 00187 | 227-326 | TCGAACAAGCGAACCGTCGTGCAGCGCAATTGATCGAAGAAGCTCGTACT CAAGCTGCGGCTGAAGGTGAGCGTATTCGTCAACAGGCTAAAGAAGCTGT | SEQ ID NO: 636 | R | dn | |
| Ab_mero | BJAB07104_ 00188 (ABTJ_ 03653) | 404-503 | CAGCACAGTAACTGTTTCAGTTGAAGTTAAACCTGAGCTTATTGCAGGTG TTGTAATTCGTGCAGGCGATCAAGTGATAGATGATTCTGCGCTTAACAAG | SEQ ID NO: 637 | R | dn | x |
| Ab_mero | BJAB07104_ 00189 | 410-509 | AAGTAGCACCAGGTGTAATTTGGCGTCAATCTGTAGACCAACCTGTTCAA ACTGGTTATAAATCAGTTGATACCATGATTCCTGTGGGTCGTGGTCAGCG | SEQ ID NO: 638 | R | dn | |
| Ab_mero | BJAB07104_ 00190 (ABTJ_ 03651) | 730-829 | CACGTATGGTCGCAATGAAAGCAGCGACAGATAACGCAGGTCAGCTTATC AAAGACTTACAACTCATCTATAACAAGCTGCGTCAAGCCGCGATTACTCA | SEQ ID NO: 639 | R | dn | x |
| Ab_mero | BJAB07104_ 00191 (ABTJ_ 03650) | 868-967 | ACTAAATCTGGTTCGATCACTTCGATCCAAGCAGTATATGTACCTGCCGA TGACTTAACAGACCCATCGCCTGCAACTACATTTGCTCACTTAGACGCAA | SEQ ID NO: 640 | R | dn | x |
| Ab_mero | BJAB07104_ 00192 (ABTJ_ 03649) | 215-314 | AACCTCATGTTGTGACGGTTCTTGCAGATACTGCAATCCGTGCTGACAAT TTGGATGAAGCTGCAATTTTAGAAGCACGTAAAAATGCTGAACAATTGCT | SEQ ID NO: 641 | R | dn | x |
| Ab_mero | BJAB07104_ 00485 | 1153-1252 | AGCATTTATTGCTGGTGTTGACCGTATCATGGATATGGCTCGTACTGCGT TGAACGTTGTAGGTAACGCGCTTGCTGTACTTGTAATCAGTAAATGGGAA | SEQ ID NO: 642 | R | dn | |
| Ab_mero | BJAB07104_ 00893 | 336-435 | TAACCATATTCAACATGATGATGCCGATTATGTGGGGGCAGTAAAAGAAA ATATGATGGGGATTATTAGAGAAAAAGAAAAGAAGAAAGGAAAGAACTGG | SEQ ID NO: 643 | R | dn | |
| Ab_mero | BJAB07104_ 01701 | 93-192 | TTTACTGGTGCATCCTTCCCTCATGTTAGATGCAAACGGACACTACAATC ATAGCCAGCTTATGCTGGTGATGGTGGGTATTTCCGGAGGCTTCATTTAT | SEQ ID NO: 644 | R | dn | |
| Ab_mero | BJAB07104_ 01703 | 381-480 | CAACATCTAGGAGTAACTTGGTTAGTTGCCCTAGGTTCTAACATGTCAGC GCTCTGGATTTTAGTTGCGAATGGCTGGATGCAAAACCCTGTAGGTGCAG | SEQ ID NO: 645 | R | dn | |
| Ab_mero | BJAB07104_ 03045 | 361-460 | AGCCGTTTCTTCAATGGTTTCCGTCGTGATGCTCACCCTATGGCAATCAT GGTTGGTGTAGTAGGCGCATTATCTGCTTTCTATCACAACAACCTTGACA | SEQ ID NO: 646 | R | dn | |
| Ab_mero | BJAB07104_ 03047 | 673-772 | TTTAGAAGAAACTCCTCCTGATGAAAGCCTTTGGGAAGGTGAATGTTTCG TATTTGATGGACGTACTGCTGTAACTCATGGTGTTGAAGAAGGTGCAAAC | SEQ ID NO: 647 | R | dn | |
| Ab_mero | BJAB07104_ 03111 | 62-161 | TCAATAGCTGCTATATGTTGAATGACCAAGGTAAAGAAGTACCAATCACA ACTGCAATGATTCGTTCAGTATGTCATCAGTTACTTAACCAGTGCCGCGC | SEQ ID NO: 648 | R | dn | |
| Ab_mero | BJAB07104_ 00049 | 107-206 | ATCATGATGACGATCGTTATGACCGTAACGATGGACGTCGATATAGTGAG TGGGAACGCAAACGTTGGGAAGAGCGTAAAAGATTATATGAACAACAACG | SEQ ID NO: 649 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Ab_mero | BJAB07104_ 00069 (ABTJ_ 03781) | 132-231 | TATGGCAAGCTTTGCTGATCCTCCTTTTGACCGAGGACATGGCCCGAAAG GTCCTAAAGGCGGACCTCGTGGTGAATGGAATGATCGTGGGCATAAATTT | SEQ ID NO: 650 | R | up | x |
| Ab_mero | BJAB07104_ 00138 | 260-359 | AAGACTTGATCCGTGCCAACATGAAAGAAATCGCACAAGTATTGACGGCT GAACAAGGTAAAACTTTGGCAGATGCCGAAGGTGATATTCAACGTGGTCT | SEQ ID NO: 651 | R | up | |
| Ab_mero | BJAB07104_ 00139 | 518-617 | ATAACCTGATTTTAGGAATTTCAATGGCTGCGGTGGCCGAAGGCATGGCA CTCGGTGTGAAGCTAGGCATCGACCCACAAGCATTGGCAGGTGTAATTAA | SEQ ID NO: 652 | R | up | |
| Ab_mero | BJAB07104_ 00140 | 1011-1110 | GGGCAAACTGAAGTAGGCATGGTGGTGTGTAATCATCATGGTTTAAAACA TGAAATTCATGCTGGTTCAGCAGGTTTTCCAAGTCCGGGCTATCGTGTTG | SEQ ID NO: 653 | R | up | |
| Ab_mero | BJAB07104_ 00444 | 132-231 | TGTGACTCTTGATATTTCAAGTGCATCACACCCGTTCTACACAGGTGAAG TACGTCAAGCAAGTAATGAAGGGCGTGTTGCAAGCTTTAACAAACGCTTC | SEQ ID NO: 654 | R | up | |
| Ab_mero | BJAB07104_ 00589 | 373-472 | GCTGATTTAACCGCGAATAAACAAGGCTTACGGACCAACTCTAGTGTTTC TACAGGACATTCTTTCGACTTAAATTCGGGAGATGACAGCGCGAAAGGTT | SEQ ID NO: 655 | R | up | |
| Ab_mero | BJAB07104_ 00590 | 1663-1762 | GAATATTATGCTGGTTTCGGTGACTGAACGTACGCAAGAAATTGGTGTGC GTATGGCTGTGGGTGCTCGACAAAGTGATATTTTGCAGCAGTTCCTGATT | SEQ ID NO: 656 | R | up | |
| Ab_mero | BJAB07104_ 00591 (ABTJ_ 03239) | 1104-1203 | TGAACAAAAACAACTTATTGAACAAGGCAAAGCAACACTAAGTGTAGTTC GCGTTTTACAAGCAGATGGTACGACTAAACCAACACAAATTTTGGTAGGT | SEQ ID NO: 657 | R | up | x |
| Ab_mero | BJAB07104_ 00622 | 436-535 | TGATTAATGGCACAGATATGCCACGCTTTTTGGTACAGAACATTGCCCAA GCCCAAGAAATGCTAGAAGCAGTCAATCACCCTGCCTTAAAAATGCAATA | SEQ ID NO: 658 | R | up | |
| Ab_mero | BJAB07104_ 01132 | 328-427 | CGTTCTAAGTTGAAAAAAATTATCGATGAAGATAGTTATTTGACTGCCGA ACATGAATTAAGTCCAATGACGATTAATGTAGATAAGGCAACGCAAGAAA | SEQ ID NO: 659 | R | up | |
| Ab_mero | BJAB07104_ 01335 | 1390-1489 | CTGGTAGAAGGCACTAAACAAGCTCAGGTTGAACTTGATAAAGCACGTAT TGCTTTTGAAAAAGCTCAGCGCGAAGGCGATTTGGCAGAAGCAGCACGTT | SEQ ID NO: 660 | R | up | |
| Ab_mero | BJAB07104_ 01499 | 775-874 | ACAGGCCAAAAACTACGTAACCACCCTCACCTCAATAAATATTCGATTCC ATTTAGTATGGAAGCCGACTCGGTAAACAGTGCAATTTTAAGCCCTGAGG | SEQ ID NO: 661 | R | up | |
| Ab_mero | BJAB07104_ 01500 | 798-897 | TAAAGTTCAATGAAGAAACAGGCCACTATGAGTTTGGCGAGATTGACTGG CACGAATTTAATGAAGTGATTGCCGGACGTGGACCATGTAATCACGAGCG | SEQ ID NO: 662 | R | up | |
| Ab_mero | BJAB07104_ 01502 | 227-326 | AGAACGTGAGTTTTTAAACCTCTTGTTGTGCGAACAACCCAATGGTGACT TTGCACAAACGATTGTACGCCAATGGTTGATGGACCATTACCATCTTCAT | SEQ ID NO: 663 | R | up | |
| Ab_mero | BJAB07104_ 01504 | 472-571 | GCCGAGCAAATTATGGATTTGAAAGATCAGTTCAAAGAACGCTTTCAACT TATCAATATTTTTTCTCGTGAGTTCAACGATAGTGAACTAATGAACGGTC | SEQ ID NO: 664 | R | up | |
| Ab_mero | BJAB07104_ 01505 | 525-624 | TGCAGTCAAGTGGTTCCGACCGAATTAACCGTTGAATATGCGGTTCAACT TGCAGCCAAAATTGCCAAACAAGCGCCTTTAGCGATTCGCGTGATTAAAC | SEQ ID NO: 665 | R | up | |
| Ab_mero | BJAB07104_ 01508 | 927-1026 | CAGGTTTAACGCTAGATCAGATGGATGTGATTGAGCTGAATGAAGCATTC GCAGCCCAATCTTTGGCTTGTATGCGTGAACTTGGTCTAAAAGATGACGA | SEQ ID NO: 666 | R | up | |
| Ab_mero | BJAB07104_ 01509 | 228-327 | AGACAACTATCCGTTTGGTATGTTTGCCGTACCGCAAGAGCAAATTGTGC GTTTACATGCATCATCTGGTACAACGGGTAAACCGACTGTGGTGGGTTAT | SEQ ID NO: 667 | R | up | |
| Ab_mero | BJAB07104_ 01629 | 567-666 | GAGTATGTAGCACAGCTCCCTAAAAATATTGTACCGCTTGCCATGCAAGT TGCAGCGATGCAACGTGATTTAATTGAGTTACAGGATCAGTCTTCTACCG | SEQ ID NO: 668 | R | up | |
| Ab_mero | BJAB07104_ 01630 | 1236-1335 | ATTGGTTATGAAAACTCTGCAAAAGTGGCGAAAACTGCTTATAAAGAGAA TAAAACTTTAAAACAAGTTGCTGTAGAGCTAGGACTTGTTACAGCAGAGC | SEQ ID NO: 669 | R | up | |
| Ab_mero | BJAB07104_ 01739 | 705-804 | AATTGCAAGTGTGCTTGGCATGATTGTCGGGAATACGGGCAAGATGGCAC GGGATTGGTCACTCATGATGCAAACTGAAATTGCAGAGTTGTTTGAGCCA | SEQ ID NO: 670 | R | up | |
| Ab_mero | BJAB07104_ 01740 | 425-524 | TTTAGCCGAGCTAGTTAAAACTACCCATACCCGCTGGTTCAGTGAAAAAT TTGACTATCAGCATAATGTGGTTGCACAGACAACGATTCAAAGTCTCGCA | SEQ ID NO: 671 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_mero | BJAB07104_ 01741 | 792-891 | CCAAAGGTACGGTTTTGCTTTGGGTGACTTACTTCATGGGACTCGTGGTT GTTTACTTGCTAACAAGTTGGTTACCAACACTTATGCGTGAAACAGGTGC | SEQ ID NO: 672 | R | up | |
| Ab_mero | BJAB07104_ 01742 | 268-367 | ACTAAAGAAGATTTAAAAGAGCTGATCTTACACAGTTCACTCTATGCGGG TTTACCTGCTGCAAACGCTGCAATGCATATGGCTGAAGAAGTCTTTAAAG | SEQ ID NO: 673 | R | up | |
| Ab_mero | BJAB07104_ 01743 | 291-390 | TCTAGAAGTATGGCAAGCCAATGCTTCTGGTCGTTACCGCCATCCAAACG ATAAGTTTATTGGTGCAATGGACCCTAACTTTGGTGGGTGTGGTCGTACC | SEQ ID NO: 674 | R | up | |
| Ab_mero | BJAB07104_ 01744 | 459-558 | TTTGAAGATGAAGCAGAGGCAAATGCTAACGATCCAATTCTAAATAGCAT TGAATGGGCACCACGTCGCCAAACACTTATTGCGAAACGTTTTGAAGAAA | SEQ ID NO: 675 | R | up | |
| Ab_mero | BJAB07104_ 01747 | 393-492 | TCGCGGGAAAATTTGGCGTTTATCCCAAGCATGGGTGAAGAAGGGCTTTG TTGATAATACTGTACAGGTCAAATTTGGTCGTATGGGAATGTCAGAGGAC | SEQ ID NO: 676 | R | up | |
| Ab_mero | BJAB07104_ 01949 | 63-162 | ATTAGGAACAGGTATTGCGATTGGCATGTGTATGTACAAGAAAAAGCAAA AGAACAGTAAGAGCTTCTCTACTGATAGTGATACCGACTCATTGATTAGT | SEQ ID NO: 677 | R | up | |
| Ab_mero | BJAB07104_ 01991 | 713-812 | TATTAGTGGTTGGATACACTTCTGCTGGTTCATTAACGTTTTATGTAGAG ACCGTTTATTCAAAAACCTATTTAACCAACTTAGGGATGGACGGAAAAAC | SEQ ID NO: 678 | R | up | |
| Ab_mero | BJAB07104_ 02013 | 837-936 | GGACTAGAACGTTTAGGTGTAGAACTCAATCCACAAGGTTTTGTGGCAAT TGATGACTATTGTAAAACCAACGTAGCAGGGCTTTATGCCATTGGTGATG | SEQ ID NO: 679 | R | up | |
| Ab_mero | BJAB07104_ 02014 | 1274-1373 | GGTGGTAGCTTTAGCATTTCAAATTTAGGAATGTTAGGCATTAAACAGTT CGATGCCATTATTAACCCACCGCAAGGTGCAATTATGGCATTAGGTGCTT | SEQ ID NO: 680 | R | up | |
| Ab_mero | BJAB07104_ 02015 | 459-558 | TCCGTTATATGTTTGGCGGAAAAGCAAAAGCACCAATGGTTGTACGTGGC ATGATTGGCGCAGGTTTCTCTGCGGCAGCTCAGCATTCTCAGTCACCATA | SEQ ID NO: 681 | R | up | |
| Ab_mero | BJAB07104_ 02016 | 305-404 | TTGCCGATTTAGATAAAGGTATGCTCGGTGCCAACGGGATTGTGGGTGGT GGGCCTCCTTTAGCAATTGGTGCAGCGTTGACAGCGAAAACCTTAAAGAC | SEQ ID NO: 682 | R | up | |
| Ab_mero | BJAB07104_ 02018 | 727-826 | CTATGCCTTATATGGCGATCGACCAGTGAGTACCACTACACTAAAAGCTG AGCTCTCACAGCTTCGAAACCTGATTCCCGATGTGATCGAGTCACGACCA | SEQ ID NO: 683 | R | up | |
| Ab_mero | BJAB07104_ 02356 | 1747-1846 | GTGACTGATGAAATCAAACTGTTAAATGAAGAAGACGGTATTGCGCCAGG TGTAGAAATTCGCCACCGTAATGAACTTGACGCAGTTCAACGTGAGCTGC | SEQ ID NO: 684 | R | up | |
| Ab_mero | BJAB07104_ 02449 | 155-254 | ATGACGCCTTAGGTAAAGTGAAATTACCAAATAAAAAAGTGCAGGCACTG ATCAATGCCAAAAAACTTGGACAAAATGATGAGACCTTGCCGTGCCCTGT | SEQ ID NO: 685 | R | up | |
| Ab_mero | BJAB07104_ 02515 (ABTJ_ 01386) | 227-326 | ATCTGCAATTGGCGGTGGTTTAGGTGGCGGTGCAGGTTATACTGTTGGTA AAAGCATGGGTGGTACAAACGGTGGTTACATCGGTGCTGCTTTAGGTGCA | SEQ ID NO: 686 | R | up | x |
| Ab_mero | BJAB07104_ 02516 (ABTJ_ 01385) | 229-328 | GCGACCGTCGTAACCGTACAGAAGCGGCTATTGGTGGTGCTTTAGGCGGT GGCGCGGGTTACACCGTTGGTAAAAACATGGGCGGTACAAATGGCGGATA | SEQ ID NO: 687 | R | up | x |
| Ab_mero | BJAB07104_ 02813 | 410-509 | CGGCATTAACTTGGTAAATGTCCGCTTTTTTGGGGAATCGGAGTTCTTAT TTTCCTGCATTAAAATTGTTGCGATTTTAAGTATGATTGGCTTCGGTGCT | SEQ ID NO: 688 | R | up | |
| Ab_mero | BJAB07104_ 02814 | 398-497 | TTGCCCAAACTCGTTTAACTCCTGCAAATGCAGCTTCTGAAATTGACCGC GTATTGCGTCAGTGTTTCCTTGAACGCCGTCCTGTACACATCCAACTACC | SEQ ID NO: 689 | R | up | |
| Ab_mero | BJAB07104_ 02816 | 606-705 | TGTGGTTGGTGCTGGTGAGATTGGTGAAGCATTATCTTCTCATCCAGATG TGCAAAAAGTCGTGTTTACGGGATCAACTCGAACAGGGCAGCACATTATG | SEQ ID NO: 690 | R | up | |
| Ab_mero | BJAB07104_ 02819 | 240-339 | AATACCCACAAGTGAAAGTGGAAACTGGTGCCCAAAGCACTTATCCAATT TATGACAATGACAGTAATAAATTAAAAGAATGGCGTGGCCGCGCGGAAAT | SEQ ID NO: 691 | R | up | |
| Ab_mero | BJAB07104_ 02995 | 847-946 | GGCTATCCTGCCGCAGGTTTGGGTATTTCTTTATCTTCGGGTGCAAATGC AATTCAGACCTCTAAGCTCATCCACCAAACTCTAGATCAGCTTACAACGA | SEQ ID NO: 692 | R | up | |
| Ab_mero | BJAB07104_ 03220 | 980-1079 | TTACATCAGCATGAAGAATCACGACGTCAATGGGTTGCAGATACCTCTCA TGAATTGAAAACTCCATTGGCTGTTTTGCAAGCGCAGATTGAAGCGATGC | SEQ ID NO: 693 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_mero | BJAB07104_ 03221 | 183-282 | TGGGAACAACACCGTGCAGAGCGTAAAGCTCGTTTTGAGCAAATTCAAAA AGCATGTGAAGGTAAAGCTGTTGGACAAACTGTCAATGTTCAAGTTGGAG | SEQ ID NO: 694 | R | up | |
| Ab_mero | BJAB07104_ 03416 | 84-183 | ACTTGCTTCTGCCTCTATTTTTGCACAAAGTGCGGGCGTTAATGCAGGTG CATCTGCTCAAGTCAACGTACAACCAGGTGGTCTTGTTAGTGGCGTAGCC | SEQ ID NO: 695 | R | up | |
| Ab_mero | BJAB07104_ 03517 | 916-1015 | GGTTTAATTGGCGGAATGCCAGTGACCTCAGTGATTGTCCGTAGTTCTGT AAATGCCAATACAGGTGCACGTAGTAAATGCTCAACCATTATTCACGGTG | SEQ ID NO: 696 | R | up | |
| Ab_mero | BJAB07104_ 03543 | 158-257 | AAAGCTTATCTAAAGTAAAAGTGACTACAACCGTCAACGGCCAACCAGGT TCTATTAGCGATTTGGTCAATAGCGGACAAGTACAGCAAGTTTCTGCTGC | SEQ ID NO: 697 | R | up | |
| Ab_mero | BJAB07104_ 03610 (ABTJ_ 00167) | 255-354 | CGGCACAAAAGACACTCAATATGGCGTAGGCGTTGAGTACTTCGTTCCTA ACTCTGACTTTTACCTTAGCGGTGATGTAGGCAGAAACGAACGTGAAATC | SEQ ID NO: 698 | R | up | x |
| Ab_mero | BJAB07104_ 03637 | 67-166 | CTAAACGGAACGGTATGGAAAACGATTGATGACCAAACCAATAAGCCCAA AGCCGTAGTAAAATTTACGGAACAGAAGGATGGAACCTTAACTGCAACCA | SEQ ID NO: 699 | R | up | |
| Ab_cip GeneID = NC_ 017847 | ABTJ_00146 | 382-481 | TCAGTGATTGCTGAATTGGGGTTGCCTGTCATTATCAAGCCTGTACATGA AGGTTCAAGTGTAGGCATGAGTAAAGTTGAGAAAGCTGAAGATTTTGCGG | SEQ ID NO: 700 | C | | |
| Ab_cip | ABTJ_00148 | 617-716 | ATGGTGTCTGTCTTGTCGATATTGGTGCAGGTATTACCAATCTGGCAGTT TATTTAGATGGCCGTTTGGCTTTAGCACGCACCTTACAGCGTGGAGGTGA | SEQ ID NO: 701 | C | | |
| Ab_cip | ABTJ_00291 | 614-713 | ATTGGTTTGACCAATAGTGAAGGTCAAGGTATCGAAGGCTTGGAAATGCA GTTGAATAAGCAACTGTCAGGTGTAGACGGTGAGCAAAAAATTATTCGCG | SEQ ID NO: 702 | C | | |
| Ab_cip | ABTJ_00304 | 588-687 | TTTGGCTTGAAGAAAATATGGATGGCCTAGTTGCAAGAGATGCTGACCTT TTAGCAGAGGCTGTTTATCGTTCATGTGCTCACAAAGCCCGCATTGTTGC | SEQ ID NO: 703 | C | | x |
| Ab_cip | ABTJ_00727 | 257-356 | TATTTGCTGAAGGAAGCTATGTTCGTGAAGGTCAGGCGCTTTATGAGCTC GACTCTAGAACGAACCGTGCAACGTTAGAAAATGCAAAAGCATCACTCCT | SEQ ID NO: 704 | C | | x |
| Ab_cip | ABTJ_00860 | 314-413 | TGACAGGAGTTGCACCTTTTACCCAATTGCAAGGTATGTTAACTGCTCAA GGGCAAGTGGCAGGTATTATGGTGACGGGTATTGACCCTAAATATGAAAA | SEQ ID NO: 705 | C | | x |
| Ab_cip | ABTJ_01079 | 1236-1335 | TCATTGGCTTAGTAAAATCTGGAAAACCGCTTGATATGGTGGATGTCCAA ATTGGGAATAACCATTATAAAGTGAAGCCAGATGAAGTGGGGTATTGGAA | SEQ ID NO: 706 | C | | x |
| Ab_cip | ABTJ_02056 | 1002-1101 | CCAGTTTCCACGAATGCTTGTAAGCGCAGAAACTATTGAAGAAAAAGCTG GTGCACTTAATCTTAAAACTGAACAACCACCCAAGTTGCCAGTCGATCCG | SEQ ID NO: 707 | C | | x |
| Ab_cip | ABTJ_02093 | 213-312 | TGTGAAAGTCGTTATATTAGGGCAAGATCCATATCATGGTCCAAATCAGG CAAATGGCTTAAGTTTCTCGGTTCAAAGAGGGGTTGCATTACCACCATCT | SEQ ID NO: 708 | C | | x |
| Ab_cip | ABTJ_02114 | 722-821 | CTGGGCGCGGTGTTACGCGCGGAACAAAACTATATGTAAAAGATGTTCCA GTTCTAGCAGTTCCCTACTTTAACTTCCCGATCGATGACCGCCGTACTAC | SEQ ID NO: 709 | C | | x |
| Ab_cip | ABTJ_02477 | 288-387 | CGTGAAATTCAAACGATCACTGCTAAAGGTAGACCGTCTAAGTTTCAGCA ACAAATAAGTGCTGATAAAGGTATTGCACGCGGTGAAGGACAAACGATTG | SEQ ID NO: 710 | C | | x |
| Ab_cip | ABTJ_02640 | 997-1096 | GCACATGAACAAACCTTAATGCGTTATGAACACCGCCGTAAAGGACAAAA TGATGCGATGATGCATAGTATGTCGGCAATTGGTTGGCTAGAAAGCAGTG | SEQ ID NO: 711 | C | | x |
| Ab_cip | ABTJ_02817 | 536-635 | AGCGCCTCAACCATTAGGCCGTTTATTACCTTCACACATTGCTTCAGCAT TCCAGCAGAATCTTGAAGAAGCGGGTGTTAAATTTGCCTTAGGCACAACC | SEQ ID NO: 712 | C | | x |
| Ab_cip | ABTJ_02821 | 1195-1294 | TGGTAAAGAAGTGACGGCGGTAATTGAATTACGTGCCCGTTTCGATGAAG AGTCGAATATCGAAGTGGCTAACGTTTTACAAGAAGCAGGGGCAGTCGTT | SEQ ID NO: 713 | C | | |
| Ab_cip | ABTJ_02920 | 831-930 | TGTGCAGTTGGCTAGAGAACAACTTGCTCAGCGTCAGCTTATGCCTGTTT TACAATGGGTGATTATTGTTGTAGCAATTGCAGTTTGGGCTGTGCCGGAA | SEQ ID NO: 714 | C | | |
| Ab_cip | ABTJ_03202 | 1860-1959 | ATTGATGGTTTAGACAATGTTGAGCTACATATTGCGCAGTGTTGCCAACC AGTTCATGGTGAATCAATTGCCGGTTATATCACGTTGAACCGTGGGGTAA | SEQ ID NO: 715 | C | | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_cip | ABTJ_03302 | 360-459 | TATGGTCCAGATTTCCCGTTAGTAACGGTCCGTGACTGGGTCAAAACTCA AGCCATGCTTTCTGACCGCTTAGGAATAAGTGTCTGGTATGCGGTGGTCG | SEQ ID NO: 716 | C | | |
| Ab_cip | ABTJ_03330 | 249-348 | TGAAGAGCATATGGCGGCAAAAGGACAAGTTTCTCCGGAAGTTTCTGTTT TGCAGCAATTGGCAAAAGATGGCTTCGTTGCAGAATTAAAACGTGCTTAC | SEQ ID NO: 717 | C | | x |
| Ab_cip | ABTJ_03425 | 576-675 | CAAGACTACCGCCAAATCATTTTAAATGAGCTGGACTTGAGTATTGAGGC AGATAACACCCGTCGTATGCGCCATTACTTCACTGGTTCAACCATGATGT | SEQ ID NO: 718 | C | | x |
| Ab_cip | ABTJ_03503 | 352-451 | GATTTAAGCGATCAAGGTATGCCAAGTATTGCGGAGCGTGCAGCAGAAAC TGAAGTGAGTCGTGATGGAATGCCTCAGCGAGTTTCTGTGCCAAAACCAG | SEQ ID NO: 719 | C | | x |
| Ab_cip | ABTJ_03544 | 97-196 | AAATACTTTGGTGTGGCGGCACAGGGGCGACTAGATGCCAGTATCTTGTT TAGCATCATTGGATATCGTTTACCTGAATTTCTAACCCTCATTTTACCAC | SEQ ID NO: 720 | C | | |
| Ab_cip | ABTJ_03793 | 1243-1342 | ACACTGCTGGCGTCATAAGACTCCGATTATTTTCCGTGCTACACCACAAT GGTTTATCAGCATGGATCAAAAAGGTTTACGTGACGGTGCGCTTAATGCC | SEQ ID NO: 721 | C | | x |
| Ab_cip | ABTJ_00185 | 132-231 | CATGTTAGTGCTTTATGTGGGCTTTATGCTACTTGTGGGCTACAACAAAG AATTTTTGATGAGTTCCTTTAGTGGTGGTGTAACGACATGGGGGATCCCG | SEQ ID NO: 722 | R | dn | |
| Ab_cip | ABTJ_00186 | 798-897 | TGCTGCAAAAATTATGGGACCAGGTAAACTTGCCGCAAACCCGATTGATG CCTTATCTCTTGGCTTAGCACTCATGTTTGGTACAGCAGGTCTTCCACAC | SEQ ID NO: 723 | R | dn | |
| Ab_cip | ABTJ_00204 | 60-159 | TAAATCACGCCACTTAACCATGATCTCGATTGCAGGGGTTATTGGTGGCT CTCTCTTTGTTGGCTCAGGCAGTATTATCTACAACACCGGCCCTGTAGTT | SEQ ID NO: 724 | R | dn | |
| Ab_cip | ABTJ_00510 | 339-438 | GCGAACCTCTTCTTGACTCACGGTTTTAAAAAGGAAAATATTTACGTTAT TGGACGTGGTTCAACTCAACCGTATGTACCGAATACAACCAATGAAAATC | SEQ ID NO: 725 | R | dn | |
| Ab_cip | ABTJ_00536 | 182-281 | TTTCAGCTGAGCTTAACTATGCTCAGCCAGCAAATCAGGCAGAAGTTATT CAGGCTCTCGACAAAGCTGGTTTTAAAGATGCTGTAGTACAAACTTTAGG | SEQ ID NO: 726 | R | dn | |
| Ab_cip | ABTJ_00689 | 390-489 | TGACCAAAAGCGTGAGTCGGTTAAAGCACTACATGGTTTGAATTTCCGTG TGATTGCAGCAGGTGATTCATATAATGATACAACGATGCTTGGTGAAGCC | SEQ ID NO: 727 | R | dn | |
| Ab_cip | ABTJ_00700 | 68-167 | GTGGAGCAATTGGTACCGGATTATTTTTAGGCTCGGCGCAAGTGATTCAA TCTGCGGGACCATCCATTATTTTAGGATATGCCATTGGTGGCTTAATTGC | SEQ ID NO: 728 | R | dn | |
| Ab_cip | ABTJ_01148 | 1608-1707 | GGCAGGTACAAACTTATGTCCAAGCGGGTTCAAATTTAGATAAAGGCTGG CGTGTGGGAGTAGGGCCGACATTAGGATGTATGAATCAGTGGCTTGAAAA | SEQ ID NO: 729 | R | dn | |
| Ab_cip | ABTJ_01199 | 313-412 | AAGTTTAGCCAAACTGGCATGGCATCGTGGTATGGTCGTCAATTTCATGG CCGTAAAACTGCAAGTGGTGAAACATTCGATATGAATGCACTTACTGCTG | SEQ ID NO: 730 | R | dn | |
| Ab_cip | ABTJ_01403 | 122-221 | TGATGGCAATTGTATGGCTTGGAACAGTGGTTACAGGCATTAGTACAATC TTAGGTTACACCACGCTGATATTTGGTTTAGTGGTTACAGCAATTCTGTT | SEQ ID NO: 731 | R | dn | |
| Ab_cip | ABTJ_01442 | 391-490 | TGTATTCGTGCTCAAGAAGGCGGCATCTCTGAAATTGATGAAGATACCAT TGCCTACCATTTCCATGAACCACTAGGTGTGGTTGGTCAAATCATTCCAT | SEQ ID NO: 732 | R | dn | |
| Ab_cip | ABTJ_01445 | 306-405 | TGTCCACAACGGTGTGAATGCCTATAACGAAAATGGCTGTGACTTTATTG TGTCGTTAGGCGGTGGCTCATCTCATGACTGTGCAAAAGGGATTGGCTTA | SEQ ID NO: 733 | R | dn | |
| Ab_cip | ABTJ_01669 | 93-192 | TTTACTGGTGCATCCTTCCCTCATGTTAGATGCAAACGGACACTACAATC ATAGCCAGCTTATGCTGGTGATGGTGGGTATTTCCGGAGGCTTCATTTAT | SEQ ID NO: 734 | R | dn | |
| Ab_cip | ABTJ_01671 | 518-617 | TTGTCAGCCTTTCTATGTTGTGTGCTCATGGCGGCGCTTGGCTTATGCTA CGCACAGACGGTGCCTTGAAACAACGCTCTGCTAAAGCAACTCAAATTAT | SEQ ID NO: 735 | R | dn | |
| Ab_cip | ABTJ_01672 | 381-480 | CAACATCTAGGAGTAACTTGGTTAGTTGCCCTAGGTTCTAACATGTCAGC GCTCTGGATTTTAGTTGCGAATGGCTGGATGCAAAACCCTGTAGGTGCAG | SEQ ID NO: 736 | R | dn | |
| Ab_cip | ABTJ_01946 | 1188-1287 | ACGGCGAACCCTGAACACTGTAAAGCTTTGGTTGAAAATTCAATTGGTAT TGTGACTGCACTTAACCCATACCTAGGTTATGAAACTACAACTCGTATTG | SEQ ID NO: 737 | R | dn | |
| Ab_cip | ABTJ_02134 | 1959-2058 | AAACGCGCAGCTGACCTCATGGAAAGCCGTATTCAAGAGTTGATGGTATT ACTTTGCCGTGAAAGTGGTAAAACTTATGCCAATGCGATTGCAGAAGTTC | SEQ ID NO: 738 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Ab_cip | ABTJ_02204 | 280-379 | GTCTCACTTGCCATCGGTATGGGTTTAGCAAACTTTTTCCAACCTGGCGC GGCGCTAGACCTAGCATTACCAACAGCTCAACAACTTAGTAGTTCTTCTC | SEQ ID NO: 739 | R | dn | |
| Ab_cip | ABTJ_02806 | 402-501 | GGCAGCCATGCTCCCTCTTTATCAACGCCTCGGTATGAATACACTGATCA TGACAGCACTTATGTTGTTATGTAGTGGTGTAATGAATCTGACCCCATGG | SEQ ID NO: 740 | R | dn | |
| Ab_cip | ABTJ_03051 | 1030-1129 | GCAGTAGCGTTAATGTCTAGCCCATATAACAACGTAGATGAAGCGCAAAG CCTTGCAGACTACCGTGGTTTGTTCTGGCGCCGTCCAGTACTTACAGCAA | SEQ ID NO: 741 | R | dn | |
| Ab_cip | ABTJ_03052 | 710-809 | TTGCAGTGAAGTTACCAGTTTTCCCATTGCATGGCTGGTTACCGGATGCC CATGCTCAAGCACCTACAGCGGGTTCTGTAGACTTGGCGGGTATCTTGAT | SEQ ID NO: 742 | R | dn | |
| Ab_cip | ABTJ_03390 | 176-275 | AGGTGAAGACCTTGTCAAAAAATTTGCTGTGAATGGTGTGTACCGTTGGT TTTGTAGCGAATGTGGTTCACCGCTTATTAGCTCGCGTGATGCTCAGCCT | SEQ ID NO: 743 | R | dn | |
| Ab_cip | ABTJ_03431 | 100-199 | GGCTTAGCAGTGCTGGGCTATGCGGTTAACTTATTTTTGTTTGCGATGGG TCGTTTGCAAGTCAGCTCACCAGCCATCCTAACCGAAACCACCAATATTA | SEQ ID NO: 744 | R | dn | |
| Ab_cip | ABTJ_03432 | 1131-1230 | TTAAAGATTGCACCGAGAATTAAACAAGAAAAAGCAGCCATGCTGACTTA TTTCCTGATTGCCATGATGCTCGCAGGCTTACCACCTTTTAGTGGCTTCT | SEQ ID NO: 745 | R | dn | |
| Ab_cip | ABTJ_03433 | 394-493 | GAGCGTGGTGATATTTTGGTCCACTCTCTTAGCACAGAAAATACTGAAAG TGATGTGCAAGACATCAAACAACGCTATGAGGCTCCACTCATGGAAATTT | SEQ ID NO: 746 | R | dn | |
| Ab_cip | ABTJ_03506 | 544-643 | CAGAACGGACAGCTACAAGTGGACATCCGTGATCAGCGTAATCAAAAAAT GGCCAATCTTTTACTAGATGCCAATATGATGCTGGATGTTCAGCTCACAC | SEQ ID NO: 747 | R | dn | |
| Ab_cip | ABTJ_03507 | 1-100 | ATGAAACCGGATATTAGTGAATTATCTGTTGAAGAGTTAAAACGCTTACA AGAAGAAGCAGAAGCTTTAATTGCAAGCAAAAAAGATCAAGCAATCGAAG | SEQ ID NO: 748 | R | dn | |
| Ab_cip | ABTJ_03734 | 909-1008 | TGTTCTACATCGACCAAAACACAATCGACTACTTACGCCTAACAGGCCGT GAAGATGCTCAAGTGGCATTGGTTGAACAGTACGCAAAAGAAATTGGCCT | SEQ ID NO: 749 | R | dn | |
| Ab_cip | ABTJ_03735 | 126-225 | TGTACCGTAGGACGTAGCGGTAACGACTTGCACTATCGTGGCTATGACAT TCTTGACCTTGCGGCAGGTAGCGAGTTTGAAGAAGTTGCTCACTTGCTCG | SEQ ID NO: 750 | R | dn | |
| Ab_cip | ABTJ_03736 | 885-984 | TTACCACTGAAGAGTTAGCATCTGCCGATGTAAGCCTTGCGCTTTATCCG CTTTCTGCTTTCCGTGCCATGAACAAGGCAGCCGAAACTGTGTATGAAAC | SEQ ID NO: 751 | R | dn | |
| Ab_cip | ABTJ_00004 | 1055-1154 | GTATCAAGTGAGGTAAAACCAGCGGTAGAGCAAGCAATGAACAAAGAGTT CTCTGCTTACTTACTTGAGAATCCACAAGCTGCAAAATCAATTGCAGGCA | SEQ ID NO: 752 | R | up | |
| Ab_cip | ABTJ_00094 | 125-224 | GGCTTGGTTTTATGCTTGCAGGGATGTTTTTTTGGGGGCTATTGGAAGTG GTCCGTTTTGGAGTTCAAGTCACTTTTGAAATGCCAGTCACATATAGTTA | SEQ ID NO: 753 | R | up | x |
| Ab_cip | ABTJ_00120 | 100-199 | TTGCCAGATTTAAATAGATCTCCGGAACAGGTAGTAGCACAGGTTTCAGA GCTGATTGAGTCTTTACAAGAGGTGGCTTTAGTCGGCAGTAGTCTTGGTG | SEQ ID NO: 754 | R | up | |
| Ab_cip | ABTJ_00121 | 880-979 | GAGTTACGTAATTTATTACCACGTAATCTTAAACTTTCGGCTGAAGATGT TTGGGATGGCGTGAACTATATTTTATCGCTTAAGTTCCAAGAACCACAGT | SEQ ID NO: 755 | R | up | x |
| Ab_cip | ABTJ_00192 | 1893-1992 | AACCATCCCACTTGGCATTATGACTTGTGTCACGGGTGTTTCAGGTTCAG GTAAATCAACACTGATTAACCGTACGTTACTCCCACTGGCTGCAACACAG | SEQ ID NO: 756 | R | up | x |
| Ab_cip | ABTJ_00357 | 160-259 | GACGACGGTTCAATCCAGCACTTTGAAGGCTACCGTGTACAACACAACTT GTCTCGTGGTCCTGGTAAAGGTGGTGTTCGTTACCATCCAAATGTTGACT | SEQ ID NO: 757 | R | up | x |
| Ab_cip | ABTJ_00375 | 427-526 | CTAAAAACAATTCCGGGTGCATCGCCTGAACTGATCCATGAAGCAGGTTT ATATGCTGACCGGATGAGTATTAATTTAGAGATGCCGACTGAGATTGGGT | SEQ ID NO: 758 | R | up | x |
| Ab_cip | ABTJ_00376 | 440-539 | AGTCTGGTTCGTCCTGATTTTAATGTCTTACCACTCATTCAGCCGCATTT TAAACGGCGTTATCAAGATCAGCGTTGGCTCATTTATGATGAGCAACGTA | SEQ ID NO: 759 | R | up | |
| Ab_cip | ABTJ_00886 | 398-497 | CTTTGGCACAAGGAACTTCTAGCGCTGCGGCCCTGCCTCAGATTCAATTT GTTTCGAACTCACCTGTTGCAGAAGCAGAAGCAGCCTTACAGTCACTAGG | SEQ ID NO: 760 | R | up | |
| Ab_cip | ABTJ_00887 | 874-973 | ACATGGCAACAAAAAATTTCGGCATTGCGTGGCCGTGTTATGAAGCGTCT GGTTGATGAAGTCACTACAGCTTTTGCCAAACATCATTATGAAATTATTA | SEQ ID NO: 761 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_cip | ABTJ_00930 | 31-130 | GCTTTGGTGAAATTGCCATTTCCAATGCCGAATGAAAGTAACCAAGCAGG CGATGCTGTACACAACCAAGTACGTCCGAAACCTGAACAATATGCAGATA | SEQ ID NO: 762 | R | up | |
| Ab_cip | ABTJ_01450 | 1020-1119 | ATATTTGTACAACCTGTATGGAAAGCATGGCGAAAAATCGAACCTCGTTT AAACTTTTACTCGGTTAAACGTTGTATGTACTGTGGTTCAAATGATCTAA | SEQ ID NO: 763 | R | up | |
| Ab_cip | ABTJ_01576 | 525-624 | CATCACCTTAGATCCATTAATTATGGAAGACCTCATGCAACAGACATCAG TCAAAGAGGTATGGGGAATCGGCTATCAATTAGTCAAACAGCTACAAAGT | SEQ ID NO: 764 | R | up | |
| Ab_cip | ABTJ_01625 | 25-124 | TCTCAGCAGCGCCCTCCTCTTACTGGCCAACGTTTACGCTCATATGCTTT TGCTTTACTCACTCGCCGAGATTACTCTAAAGCAGAGCTTATCGAGAAAT | SEQ ID NO: 765 | R | up | |
| Ab_cip | ABTJ_01626 | 446-545 | CTAAAGCAGAAATCGAAGGTGAGATGGGTGACTCTCATATGGGTCTACAA GCACGTCTTATGAGCCAGGCACTTCGTAAAATTACGGGTAATGCTAAACG | SEQ ID NO: 766 | R | up | x |
| Ab_cip | ABTJ_02066 | 269-368 | AAAACATACTTATAACGCCCGTCATGAAACAATTTTCCAAAAACCGAGTT TTCAAGAAGCTGCTCTTAAATGTAAGTTCGGTGTAATACCCGTGACGGAG | SEQ ID NO: 767 | R | up | x |
| Ab_cip | ABTJ_02280 | 200-299 | ACAACGATAAAATTTACCACATTCCTTTGGCGACAGAACGTGTTGCTGCG GGTTTCCCATCACCAGCGCAAGACGATATTGAGCAAGCACTCGATTTAAA | SEQ ID NO: 768 | R | up | |
| Ab_cip | ABTJ_02632 | 77-176 | GGGTCGCCAGTAATTATCATTCACGCCGTGGAGAGGTCGATCTGATTGTA AAACGCGGTAACGAATTGATTTTTGTTGAGGTAAAAGCGCGAGGGCAGGG | SEQ ID NO: 769 | R | up | |
| Ab_cip | ABTJ_02906 | 812-911 | ACATGAAATCGCGCTTGATATTCAAGAAGGCGCCGACATGGTGATTGTAA AACCGGGCATGCCATATCTGGATGTGGTACGTGAAGTGAAAGATACCTTT | SEQ ID NO: 770 | R | up | |
| Ab_cip | ABTJ_03068 | 1045-1144 | TTATGACATTTATGGTGCAATGCGTGACAACGCGATGCTCTCTAAATGGG CAGGTGGTTTAGGTAATGACTGGACACCTGTACGTGCCTTGAACTCTTAT | SEQ ID NO: 771 | R | up | x |
| Ab_cip | ABTJ_03070 | 377-476 | TTAAATATGAGTGGGCTTGGCAAAAAATATCTAGATGGTTGTGCAAACCAC TGGATGCCTCAAGAAGTGAACATGAACCACGATATCGCACTTTGGAAGTC | SEQ ID NO: 772 | R | up | x |
| Ab_cip | ABTJ_03340 | 1-100 | ATGACTAAACCACCATATCATGATGATCAAGCGTCATTTTCCGCACCCAT TGAAGATTTGCAAGTGCGAATTGCATTTTTAGATGATTTAGTTGAGGAAT | SEQ ID NO: 773 | R | up | |
| Ab_cip | ABTJ_03609 | 1577-1676 | AACTACCGTGCTGGGGACCAATATTTAAGTCATGCTGTCGGGAAAACCAA TCAGCGAGTTTACTTCCTTGATGAAACAGGGCGCAGCTATGCCTTGCCAA | SEQ ID NO: 774 | R | up | x |
| Ab_cip | ABTJ_03784 | 72-171 | GCTAGGTGGTTGTGCCAAAAAAGAGGAGCACACCACAACAACTTTAAATA TCGGCTATCAGAAATATGGCATCCTTCCTATTCTAAAAGCACGTGGTGAC | SEQ ID NO: 775 | R | up | |
| Ab_cip | ABTJ_03785 | 197-296 | AATTTCCAAATGCCAAAATCACTTGGAATGAGTTCCCCGCTGGCCCTCAA ATTTTAGAAGCCTTAGCTGTTGGCTCACTCGATGTTGGCGTTACTGGAGA | SEQ ID NO: 776 | R | up | |
| Ab_cip | ABTJ_03808 | 298-397 | CAGTATTTCCCGAATGTACAGATCATTGCTACGCCGGAAACAGTAAAGCA TATTCAGGATACTCAAGCGCTTAAAGTTAAATATTGGGGGCCACAAATGG | SEQ ID NO: 777 | R | up | |
| Ab_cip | ABTJ_03827 | 339-438 | CCCAACTGAAATCCAGTTTCAAGACAAAACATATGCAAGCGAAATTGCCC AGTTCTTTGTTCAGGAACTCTTAAAACACGGTACAACCACGGCCCTCGTT | SEQ ID NO: 778 | R | up | |
| Ab_cip | ABTJ_03829 | 144-243 | CATGGCAGACTTATGCCGTACGATTACCAAACCACATGAACTCGACTTTA TGACAGTGTCTAGCTATGGCGGCGGTACCACTTCAAGTCGAGACGTTAAA | SEQ ID NO: 779 | R | up | |
| Ab_gent GeneID = NC_ 017847 | ABTJ_00113 | 325-424 | TGTATGCTAGATGACAATGAAGAACGTATTCGTCTAGCTCAATATGGCAC TTCTAATATTGGCCGTTTCAAGACGCTTTATCGCCGTGGTTTAGGTATTC | SEQ ID NO: 780 | C | | x |
| Ab_gent | ABTJ_00134 | 254-353 | GCCTAAAGCAGTTTCTCAATATGATGAGAACTATGGCCAAAGCCAAGTTT ATTACCATCAAGTCAACTTCCAGATTAAAACCAAGCCTTCAGAGCACTAC | SEQ ID NO: 781 | C | | x |
| Ab_gent | ABTJ_00655 | 351-450 | TATATCTATATTCATGGTACACCTGATAAAGAACCGATGGGGGTTCCAAT GTCACATGGGTGTATTCGAATGCGTAATGAAGAAATCATTGAATTGTTTG | SEQ ID NO: 782 | C | | x |
| Ab_gent | ABTJ_00666 | 964-1063 | AGGAATTGGTTTAACTGGACCAAATGCTATGGCTCTAGCCATGTCAAAGC AAGGTGCTCGTGCAGGAACAGCCAGTGCAATTATGGGCAGTATGCAATTT | SEQ ID NO: 783 | C | | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_gent | ABTJ_00735 | 95-194 | GGGCATCTTTAGAGACTCGCCGTAAAGACTTGCAATCAAAAACTGAAAAG TTACAGGCAGAGCGAAATGCCGGTGCTAAACAAGTGGGTCAGATTAAAAA | SEQ ID NO: 784 | C | | x |
| Ab_gent | ABTJ_00860 | 314-413 | TGACAGGAGTTGCACCTTTTACCCAATTGCAAGGTATGTTAACTGCTCAA GGGCAAGTGGCAGGTATTATGGTGACGGGTATTGACCCTAAATATGAAAA | SEQ ID NO: 785 | C | | x |
| Ab_gent | ABTJ_00885 | 565-664 | TCGTGTCACGATCTGCAAACCTCATGGATGTACCCATTACAGTTGAGGGT GCAGAAGAAGTTGCACGCCGTTCACGCGGAACACCGCGTATTGCCAATCG | SEQ ID NO: 786 | C | | |
| Ab_gent | ABTJ_00886 | 398-497 | CTTTGGCACAAGGAACTTCTAGCGCTGCGGCCCTGCCTCAGATTCAATTT GTTTCGAACTCACCTGTTGCAGAAGCAGAAGCAGCCTTACAGTCACTAGG | SEQ ID NO: 787 | C | | |
| Ab_gent | ABTJ_01254 | 645-744 | GTAGAAAATGAGGATTGGGAAGAACAAAGTACATCTGCTTTGCATGACGC AATGAACCAGCTAGATGACCGTTCACGTAATATTTTGCAGCGCCGTTGGT | SEQ ID NO: 788 | C | | |
| Ab_gent | ABTJ_02479 | 378-477 | TTACTGTTCCAAACGGACATGAGGAAGTGCGCCGTCGTGCGGATTTGGTA ACACAGGCGATGGGTGGCCGTGGAGCTGTGCGTGAAGTTTGTGATATGTT | SEQ ID NO: 789 | C | | |
| Ab_gent | ABTJ_02819 | 326-425 | TCCTGACACGGTTACTTGATGAAGTGCATCAACAATTACCGAAGATTCAG TTGCATTTACATGAAGCTCAAAGTGAGAAGATTGTAGAGCGCCTAGAACA | SEQ ID NO: 790 | C | | x |
| Ab_gent | ABTJ_03131 | 621-720 | TGCTTTTTATGCACAAAGTAAATTACTTCATGATGCTTTAGAGCAAGTTC AATATGGTGAGTTAGCTAAAAGTCATTGGTATTTCTTGGGTGTTGCAGGC | SEQ ID NO: 791 | C | | |
| Ab_gent | ABTJ_03399 | 562-661 | AAACTGGTGACATGGGTATTGGTAAAGATGGCGAGCCTACACATAACTTT ACTCCGGGTTATGAACTTCACGCTAAATACACTCTCTTTGCTGAAGGCTG | SEQ ID NO: 792 | C | | x |
| Ab_gent | ABTJ_00211 | 1097-1196 | AAGTGACCTTAACGCGTGCAGTTGTAGACTCGCAAACTATTGCTTTAAAC AAAGAGCTACAACAACGTCACTTAGAACCAAACCGTAAAGTATTCTACTG | SEQ ID NO: 793 | R | dn | |
| Ab_gent | ABTJ_00526 | 25-124 | GAATTAGAGTTATTTGAAGTTAATCACGCTGTACAAAACACCCAAAAAGA GATTGCAACACGTTTTGACTTCCGTGGTCATGATGTTTCTATCGAATTAA | SEQ ID NO: 794 | R | dn | |
| Ab_gent | ABTJ_00537 | 519-618 | GATCACTGTTCAGTTTGCTGACAATGCGGATCGTGATGCAGCAATGGATT TTTTACGCCGTAATGGTAATGAATATACCCAACAGGCATTAGCGAGCACG | SEQ ID NO: 795 | R | dn | |
| Ab_gent | ABTJ_00669 | 139-238 | TTCTTGCAAAGTATTCGTGTTATGAAAAGCAGCCGTACAGAAGGCGAAGA TGAGCATGGCCTTACACCTTTCCAAGCGTTTGTAACTGGTCTTGCGAGCC | SEQ ID NO: 796 | R | dn | |
| Ab_gent | ABTJ_00709 | 85-184 | AATGCGGCAACTTCTGATAAAGAGGAAATTCGAAAGCTTCGTCAAGAAGT TGAAGCATTAAAAGCATTAGTTCAAGAACAACGTCAAGTACAGCAACAAC | SEQ ID NO: 797 | R | dn | |
| Ab_gent | ABTJ_00759 | 769-868 | AAGGTAACATCGGTTGTATGGTTAACGGTGCTGGTCTTGCAATGGCAACT ATGGACATCATTAAACTTTATGGTGGTCAGCCTGCAAACTTCCTTGACGT | SEQ ID NO: 798 | R | dn | x |
| Ab_gent | ABTJ_00816 | 116-215 | CAGATGCTTCTGGAAATACCGAATTAGCGTTAGATGGGGGTAAAATCCAA AAAGGTTTGTCTTCAAATGCCAAAACTACATTAAACATGGATGCTGAAAC | SEQ ID NO: 799 | R | dn | |
| Ab_gent | ABTJ_01072 | 647-746 | AACGGTATCAAACAAGGTAACCGTAATGCTTTACTTTACACTGACCCAAG TGTTGATGGCTTAAAAACAGGCCATACTGATGAAGCTGGTTACTGCTTAA | SEQ ID NO: 800 | R | dn | |
| Ab_gent | ABTJ_01672 | 381-480 | CAACATCTAGGAGTAACTTGGTTAGTTGCCCTAGGTTCTAACATGTCAGC GCTCTGGATTTTAGTTGCGAATGGCTGGATGCAAAACCCTGTAGGTGCAG | SEQ ID NO: 801 | R | dn | |
| Ab_gent | ABTJ_02058 | 423-522 | GGCGTGCGATTATTGGCTTTGTAGATGGAACAGAAAATCCTGAACCTGTA ATTGCTGCACAATGGGCATTAGTGGGTAACGAAGATCCTGACTTTATTGG | SEQ ID NO: 802 | R | dn | |
| Ab_gent | ABTJ_02610 | 667-766 | TGAAAGACGCAATCTTCCGTGAGCCAATCGATCAGTCTACTAAGCTTTAT GTCAACTTATTGGGTGTTGCTGAAGCGAACAAAAATGACCCGATCTATAC | SEQ ID NO: 803 | R | dn | |
| Ab_gent | ABTJ_02809 | 620-719 | AAATGGCGATAACGTTGTAAATCCATCAGCTCATACTCCTTGGTACAAGG GGCAAACCTTAATGAGTATTCTTGAGTCTGTGGAAATCAACCGCGAGTCA | SEQ ID NO: 804 | R | dn | x |
| Ab_gent | ABTJ_02810 | 411-510 | GCGCCGTGACGAAGAAAAATCACGTGCGAAAGAGCGTGTGTATTCATTCC GTGATAGTAAACATCGTTGGGATCCTAAAAACCAACGTCCTGAACTTTGG | SEQ ID NO: 805 | R | dn | |
| Ab_gent | ABTJ_02921 | 338-437 | ACCATATTCAACATGATGATGCCGATTATGTGGGGGCAGTAAAAGAAAAT ATGATGGGGATTATTAGAGAAAAAGAAAAGAAGAAAGGAAAGAACTGGTT | SEQ ID NO: 806 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_gent | ABTJ_03051 | 1024-1123 | TTTGGTGCAGTAGCGTTAATGTCTAGCCCATATAACAACGTAGATGAAGC GCAAAGCCTTGCAGACTACCGTGGTTTGTTCTGGCGCCGTCCAGTACTTA | SEQ ID NO: 807 | R | dn | |
| Ab_gent | ABTJ_03052 | 717-816 | GAAGTTACCAGTTTTCCCATTGCATGGCTGGTTACCGGATGCCCATGCTC AAGCACCTACAGCGGGTTCTGTAGACTTGGCGGGTATCTTGATTAAAACA | SEQ ID NO: 808 | R | dn | |
| Ab_gent | ABTJ_03053 | 683-782 | TAAATCTGCACAAATTCCATTGCAAACATGGTTAGCAGATGCGATGGCAG GTCCTACACCTGTTTCTGCATTAATCCACGCAGCAACAATGGTAACAGCT | SEQ ID NO: 809 | R | dn | |
| Ab_gent | ABTJ_03054 | 128-227 | CTGCAGCGTTAGCATTCGTTCTTGCGGGTAGCGTATGGGCACAACCAGAT GGACAAGTCATGTTCATTCTGATTTTAACCCTTGCTGCGGCAGAGGCGTG | SEQ ID NO: 810 | R | dn | x |
| Ab_gent | ABTJ_03056 | 168-267 | GGAAGAGCGTTGTGTGGCATGTAACCTTTGTGCGGTTGCATGTCCGGTTG GCTGTATTTCACTGCAAAAAGCTGAAAAAGAAGACGGACGTTGGTATCCG | SEQ ID NO: 811 | R | dn | |
| Ab_gent | ABTJ_03057 | 341-440 | TGGGTGTTGCGGACATGAGCATCGGTTTGTTGTTCTTTATGGCAATGGCT GGTATTGCGGTTTATGCAGTGTTATTCGGTGGTTGGTCATCAAATAACAA | SEQ ID NO: 812 | R | dn | x |
| Ab_gent | ABTJ_03058 | 1755-1854 | GTGAAACTGAAACTGTGAAACAGGCTGATATTGTACTTTCAGCAGCAAGC TTTGCCGAAGGTGATGGTACTGTCGTAAGCCAAGAAGGTCGTGCACAACG | SEQ ID NO: 813 | R | dn | |
| Ab_gent | ABTJ_03242 | 220-319 | TTTGCTGAGCAATTCGGTTCTAAGCTTGTGTTTCCATGTGATGTTGCCGT TGATGCTGAAATTGATAATGCATTTGCGGAACTTGCAAAACATTGGGACG | SEQ ID NO: 814 | R | dn | |
| Ab_gent | ABTJ_00249 | 526-625 | TGCTGGAAAGGTAAATTTGCGTCGCGTCACCATTATTCAACTTGGTGTCG CCTCTCTACTTTCTTTTACCATTATGCCTATAGTAGGTGAACATACAATT | SEQ ID NO: 815 | R | up | |
| Ab_gent | ABTJ_00346 | 530-629 | GCAATTGCTTTACTTGCACTGCTGAGTTGGGTTGGCTTAAAGAAACAAAT GCCTAGTCATAAGGTGAGTGTAACCAAACAGCCTTTTAGTTATCTTTTTG | SEQ ID NO: 816 | R | up | x |
| Ab_gent | ABTJ_00618 | 443-542 | TAAAAAGCATCCGGGTCTTGTCCGAATGCTTCGTCAGTTTGAGGCAACAT GGCAAAAACAGTTGGGCACTTTAGGCGGCGGTAATCACTTTATAGAGTTA | SEQ ID NO: 817 | R | up | |
| Ab_gent | ABTJ_00738 | 190-289 | TTAGAGAGAGACGGTTTTATCGAACGAAAAATTCAGGATACTTCCCCTAT TCGTGTCGATTATTCCCTCACGCCACTTGGGCAAAATGTAGCTGCTATGG | SEQ ID NO: 818 | R | up | |
| Ab_gent | ABTJ_00744 | 34-133 | ATGTTAGACCGCACTCCATCTCGCGAACTCCGTGAAGACCTTTGGGTATT TCCAATGGACTATCCAATTAAACTCATTGGCGATGCGGGTGAAGAATTAC | SEQ ID NO: 819 | R | up | x |
| Ab_gent | ABTJ_00745 | 647-746 | AGGTGATGATGATTCTGAAGGTGATTCAGGTCCAGACCCTGAAGTTGCAA AAGTTCGTTTTGCTGAATTAGAAGCTGCATGGGCTCAAACTAAAGCTGTC | SEQ ID NO: 820 | R | up | |
| Ab_gent | ABTJ_01034 | 324-423 | GCTTAATGAATGTATGCAGCAACATCCGAATCTGCCGCTTGAACTTCAAA CTCACCCGACAGGATATTTGTTAAATGCTGTGCAACAAGGAGAAGTCGAT | SEQ ID NO: 821 | R | up | |
| Ab_gent | ABTJ_01384 | 484-583 | GTGGACATCAGGAAACAGAAGATCAGTTCCCGAGAGATGTTGTAGAAATC TTGCAATATTTCAAAGCACCTCAAGTGGGCCAAAAGATTATTGCGACACC | SEQ ID NO: 822 | R | up | |
| Ab_gent | ABTJ_01385 | 224-323 | AGCAAGCGACCGTCGTAACCGTACAGAAGCGGCTATTGGTGGTGCTTTAG GCGGTGGCGCGGGTTACACCGTTGGTAAAAACATGGGCGGTACAAATGGC | SEQ ID NO: 823 | R | up | x |
| Ab_gent | ABTJ_01403 | 122-221 | TGATGGCAATTGTATGGCTTGGAACAGTGGTTACAGGCATTAGTACAATC TTAGGTTACACCACGCTGATATTTGGTTTAGTGGTTACAGCAATTCTGTT | SEQ ID NO: 824 | R | up | |
| Ab_gent | ABTJ_01486 | 329-428 | GGGAAAGAACGATCTCTGTGCGGATTTTACATGCGATTGGTTTTGAGGGT GGTTTGCTGATTGCGACTGTTCCAATGATTGCATATATGATGCAGATGAC | SEQ ID NO: 825 | R | up | |
| Ab_gent | ABTJ_01492 | 127-226 | AGTGCAGCATTGAATTTAACTGCCAATCAGCTTTTATGGATTATTGATAT TTATTCGCTGATTATGGCGGGTTTGATTTTACCGATGGGTGCACTCGGTG | SEQ ID NO: 826 | R | up | |
| Ab_gent | ABTJ_01592 | 443-542 | GCATCGGCGATTTATACATGCTTATTGCAATTATTTTGTGTGGATTTGGC TATGCAGAAGGCGGAGTACTTTCGAAAAAAATAGGTGGATGGCAGGTGAT | SEQ ID NO: 827 | R | up | |
| Ab_gent | ABTJ_01709 | 705-804 | AATTGCAAGTGTGCTTGGCATGATTGTCGGGAATACGGGCAAGATGGCAC GGGATTGGTCACTCATGATGCAAACTGAAATTGCAGAGTTGTTTGAGCCA | SEQ ID NO: 828 | R | up | |
| Ab_gent | ABTJ_01710 | 425-524 | TTTAGCCGAGCTAGTTAAAACTACCCATACCCGCTGGTTCAGTGAAAAAT TTGACTATCAGCATAATGTGGTTGCACAGACAACGATTCAAAGTCTCGCA | SEQ ID NO: 829 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_gent | ABTJ_01711 | 792-891 | CCAAAGGTACGGTTTTGCTTTGGGTGACTTACTTCATGGGACTCGTGGTT GTTTACTTGCTAACAAGTTGGTTACCAACACTTATGCGTGAAACAGGTGC | SEQ ID NO: 830 | R | up | |
| Ab_gent | ABTJ_01787 | 465-564 | AGGTGCGCTTGCCGAAGTTACACTTAATTTTATTGCCCAAGACCCTTCTC AAGCCGAGCGTTACCGCAAATCTGGTTTTGAAGCATTTTGGCATGCAGTT | SEQ ID NO: 831 | R | up | |
| Ab_gent | ABTJ_01807 | 39-138 | AATGGGGCTATCGGTCGAAGCTGGGCTTTTAGGGCCGTTAGGAAAGGAAG TAGGTGAGTTGTGGGCCACTTTTAGTATTTTTGGTGTGGGTGCAGCACTT | SEQ ID NO: 832 | R | up | |
| Ab_gent | ABTJ_01924 | 178-277 | ACTATGCACCATGTTAAAACAGGCGCATTGTCTATTAGCCGCTTGGAATA TGGCGCAGATGTTATTATTGAACCAGATCATCTTGATAACTTTTACTTAA | SEQ ID NO: 833 | R | up | |
| Ab_gent | ABTJ_02047 | 380-479 | AAATCACTCTTGCCAACCTCATTAGCCGAGACAACGTTCAAACTGTTGCA TTACGCCAAAATGTAACTGGCACAGATTCAGCTCTTTTATCGGGTACAGG | SEQ ID NO: 834 | R | up | |
| Ab_gent | ABTJ_02050 | 125-224 | AATTTGTAGATGATATCGATGAACATGATCAAATTTTCGAACAATTCGGC GTTAAGGTTTTTGTAGATCCTAAAAGCTTAGTTTACTTAGACGGCTTAGA | SEQ ID NO: 835 | R | up | x |
| Ab_gent | ABTJ_02051 | 219-318 | AGCTCTTAAAAAGCAAGATCATCATCTTGATCAATCTATTAGTGATTTCG AATTTCTACAATCCGCTTTAGAACTTCGTGAACAACTTGATGAAGCGACA | SEQ ID NO: 836 | R | up | |
| Ab_gent | ABTJ_02052 | 1358-1457 | TACTTCATGGCATTCCACCAATGACTGCAGGCCAAGCTCGTATTGAAGTC ACTTTCCAAGTTGATGCAGATGGCTTACTCACCGTTTCTGCTCGTGAAGC | SEQ ID NO: 837 | R | up | |
| Ab_gent | ABTJ_02215 | 737-836 | AGCTTACCTTTAGATGTATTACGTATTGCGATTCCACTCACGATTTACTT TGTAGTGATGTTCTTTATTAGTTTCTTTATGAGTAAACGGATGAGGAATA | SEQ ID NO: 838 | R | up | |
| Ab_gent | ABTJ_02315 | 151-250 | GACGGGGCCGACTTAGGTTTTTTGGCATTAAGCCTCACTAGTCTTAAAGC AGAGTTTCATTTAACTGGTGTGCAAGCCGGAACATTAGGAAGCTTGACAC | SEQ ID NO: 839 | R | up | |
| Ab_gent | ABTJ_02317 | 229-328 | GCAGGTGCAGATCTAAAAGAAATGGCAACCGCAACTTCCACAGAAATGTT ATTGCGTCATACAGAACGTTATTGGAACGCGATTGCCCAGTGCCCTAAAC | SEQ ID NO: 840 | R | up | |
| Ab_gent | ABTJ_02318 | 367-466 | TTAAAGCAAGCACAGGCAGGCGTGATTATAAATATGTCATCTATTGCCGG ACGCTTAGGCTATCCATATCGATTGGCCTATTCCACTTCAAAATGGGGAC | SEQ ID NO: 841 | R | up | |
| Ab_gent | ABTJ_02324 | 591-690 | GTGGTTGAAGATGTGGCAATTAAACTTGCTCACAAACCAAGCCAAGCCTT ACAGCTCAGTAAAAAGTTACTAAGAGATATGCCAATTGATGATCTACTCA | SEQ ID NO: 842 | R | up | |
| Ab_gent | ABTJ_02325 | 220-319 | CAGATGACAGGTTTGCCAAAACCAACCATTACTCGCCTCACACATACCTT GTCGCGTTTGGGTTATATCAAACAAGTACCTAACTCAAGCAAATTTCAGC | SEQ ID NO: 843 | R | up | |
| Ab_gent | ABTJ_02327 | 148-247 | TTCGGTCTTACAATTCCCGAAGAATATGGTGGCTTAGGCATCACTATGGA AGAGGAAGTCAGAGTTGCATTTGAACTTGGACAAACTTCACCGGCTTTTC | SEQ ID NO: 844 | R | up | |
| Ab_gent | ABTJ_02445 | 190-289 | GGTCAAACCCTTAAAAAAGATTATGCTTCTGTTGCATCAAAATTTAAGTT TTCTGAAAAGCAATTAGGTAATGCTTCTGAAGGTTCAAATTGTAGTCAGT | SEQ ID NO: 845 | R | up | |
| Ab_gent | ABTJ_02507 | 111-210 | CAATGCCAATGGTTCAGTTTTGTATATTGTTAAAGAGGAAAGTAAGATTC CACTGGATGTAGAAAAGTTTAAAACTGACCGACCTAAAATCTATGATGCG | SEQ ID NO: 846 | R | up | |
| Ab_gent | ABTJ_02808 | 2-101 | TGAATACTAAAATCACCTATACTGCTTTCACTGGAAGCACGCTTATTGCG AGTGACTCCCTTGTTGAACTTGCAAAGAAACTAAAAGCTCTTCCTAAAAC | SEQ ID NO: 847 | R | up | |
| Ab_gent | ABTJ_02847 | 1054-1153 | GCAGGTTTAATGTTTGGCCTTATGTTTGGGGTAAGTGGTATTGCCGCAGC GGGGCTAGGGCATTTAGCGGATATTAACGGCATTGAATGGGTATTTGGTT | SEQ ID NO: 848 | R | up | x |
| Ab_gent | ABTJ_02861 | 756-855 | CTGGTACGTCAACTCACCATTGGGTGGTGCATTTGAATATTACACCAACG ATGATTATTTGACCGAAGAATGGCAGCCACGTGTAGAAGAACATCGTCTA | SEQ ID NO: 849 | R | up | |
| Ab_gent | ABTJ_02862 | 623-722 | TTGAAGCAACCGAGTATGTGCCACAGGAACGTCATGATTTATATGTCAAC GGAAGAGCGATTCAACGCCAGCAACTTCCACAAGATTTAAATGGAACAGC | SEQ ID NO: 850 | R | up | |
| Ab_gent | ABTJ_02863 | 315-414 | AATGACTGGAACCAAGTGTTTAAAGAGCTATCCGGTCATTGAACAGCATG GTGCAATCTTCATCTGGTTTGGTATCGATGCAAATGAACAACCCGCACCG | SEQ ID NO: 851 | R | up | |
| Ab_gent | ABTJ_03055 | 151-250 | GCCGGCGCCCTCGAAATCATTGTTTATGCTGGTGCGATTATGGTCTTGTT CGTATTCGTTGTGATGATGCTTAACTTAGGGCAACACACAGTTGAACAAG | SEQ ID NO: 852 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Ab_gent | ABTJ_03456 | 118-217 | CCGTGGACACGTGATGGTCGAGTTCGTGGTGACGTTATTCAGGTCTCTTC AGATGTAGCAGGACTTGTAACGGAAGTATTGGTTCAAGATAACCAGACTG | SEQ ID NO: 853 | R | up | |
| Ab_gent | ABTJ_03457 | 67-166 | CCTGCTTTGCTCGTCCAAGCCATTTTTGCATATATATGTTTTCGCTGGTT AAGTCCCTTAACCAACAAATGGATTGCACAAGGCTGGATTGCATTACCCA | SEQ ID NO: 854 | R | up | |
| Ab_gent | ABTJ_03458 | 851-950 | GAACAAAAAGATCAGATGACTGATGAAAATATTCTGCAGTTACCTGACGA GTTTGAAAATGATTTCTTGAACTTAAATGATTCGGCTTCTGAACATCAGC | SEQ ID NO: 855 | R | up | |
| Ab_gent | ABTJ_03715 | 235-334 | GGCGATGTATTTGATCAGGTGGCTAGAGACTTAGTTGAGATTCCTGAAGT ACTCGAATGTCACCTCATTTCAGGTGAATTTGACTACCTTGTAAAAGCGC | SEQ ID NO: 856 | R | up | |
| Ab_gent | ABTJ_03774 | 235-334 | TACCAACAACGTAGCTATTCGATTATTGAAGTAACCACTCAAGGTGAAAT CGCTTTAGGTATTAAAGTACAAGGCTTGGTGTCTCGTGCAGCTCAACTAT | SEQ ID NO: 857 | R | up | x |
| Pa_cip GeneID = NC_ 008463 | PA14_04390 | 12-111 | CGATGGTTTTCGCCCGAATGTCGGCATCATTCTCGCCAACGAGGCGGGGC AGGTGCTGTGGGCGCGGCGTATCAATCAGGAAGCCTGGCAGTTCCCGCAG | SEQ ID NO: 858 | C | | x |
| Pa_cip | PA14_04630 | 1118-1217 | CCTTCTTCAAGGCCGGTCCGGCGGGCATCCCGACCCAGACCGCGTTCAGC CAGAACACCCGCTGGCCGAGCCTGGACGACGACCGCGCCGAGGGCTGCAT | SEQ ID NO: 859 | C | | x |
| Pa_cip | PA14_05480 | 542-641 | AGCGTATCCGTTCGCGCTACGACGAACCGTCGCGCCTGTCGCTGCTCTAC CTCGCCCAGCAGGGCCGCGCCTACCGTGGCGTCGACGACCGCGACCTGCG | SEQ ID NO: 860 | C | | |
| Pa_cip | PA14_05560 | 714-813 | TGCTGGCGCACCTGGTAACCGTCGGCGCCTGGGAACAGGTGCTGGTCTTC ACCCGTACCAAGCACGGCGCCAACCGTCTCGCCGAGTACCTGACCAAGCA | SEQ ID NO: 861 | C | | x |
| Pa_cip | PA14_05920 | 764-863 | ACGAGCGCGCCAGTTCCTCGCACTACCCGTACAACCGGCTGGCCGAGGCG TTCTTCCACAGCGACGTGCTGTTCCGCTGCCAGCGCCTGCTCAACCAGCA | SEQ ID NO: 862 | C | | x |
| Pa_cip | PA14_07700 | 157-256 | TATGCCATGCGCGAGTCGGTGGTCAGCGTCCTGGGCAACCACGACCTGCA CCTGCTGGCGGTGGCGCACAAGTCCGAGCGCCTGAAGAAGTCCGACACGC | SEQ ID NO: 863 | C | | x |
| Pa_cip | PA14_10040 | 711-810 | TCGCCGACGATCCCGATACCCGCGGCGACCTCTGGCGCATGCAGCCCTGG GTGCCGATCCCCAAGGCCTCCGAGGTACGCCCGGCGAGCTACCCGGCCCT | SEQ ID NO: 864 | C | | x |
| Pa_cip | PA14_14900 | 290-389 | GTTCGTGGCCAAGGTCGCGGTCGACAGCGGCAAGCTGGATGACGCCGTTG CCGAGCTGAAGGCGGTCATGGACAAGCCGGCCGACGCCACCCTCGGCGAA | SEQ ID NO: 865 | C | | x |
| Pa_cip | PA14_25000 | 743-842 | CGCGGCAGGACCCGGAAAAGGCCCTTAGCCTGCTCGACTACTACAGCTCG GCGCTACCCTTCTCCAGCGACGAGAAGGTCGCCATCGCCCCGCGAGATCGG | SEQ ID NO: 866 | C | | |
| Pa_cip | PA14_25880 | 335-434 | CGAGATCGTCGAAGTGGTCAGCCCCGACACCTTCAAGCGTCCGATCTACG CCGGTAACGCCATCGCTACCGTGCAGTCCTCGGCTGCGGTCAAGGTGATC | SEQ ID NO: 867 | C | | x |
| Pa_cip | PA14_30230 | 281-380 | GTGCAGAGTTCCGGCAAGCGCGAAGTGACCGGGGCCAATGTCCTGGTGGC GATCTTCAGCGAACAGGAAAGCCAGGCGGTGTTCCTGCTCAAGCAGCAGA | SEQ ID NO: 868 | C | | x |
| Pa_cip | PA14_02520 | 120-219 | ATGGGCTGCGGCAACGGCGCCAGCCGCACCCAGCATCCCAGCGAACTGTT CGGCGAGGACTGGGCCGGTGAATGGGAAGTCGAAGGAACGGAGGACGCCA | SEQ ID NO: 869 | R | dn | |
| Pa_cip | PA14_16860 | 2184-2283 | GACCGCCGAGGAACTGGAGAACCTCTGCACCGTGATGGCCCAGCGCCTGT CGATCCTGCATGGCCTGAACGCCCCGGAGTTCTTCGACAAGAGCCTGTTC | SEQ ID NO: 870 | R | dn | |
| Pa_cip | PA14_17550 | 383-482 | CATGGCCGCCGCCCACGAAGGCGCCGGGCTGGAGAACAGCCTGGGCTTCA ACATCACCCTGCCCTTCGAGCAGCACGCCAACCATACGGTGGACGGCAGC | SEQ ID NO: 871 | R | dn | |
| Pa_cip | PA14_25130 | 211-310 | GCTCCTCGCGTGGATGCATTGCTGAATGCCGAAGTGCTGGCGGCCGCGCC CAGCCCCGAGCTGGCTGAACTGGTGGAGTTGGCGTCGCAGCCGGAAACCT | SEQ ID NO: 872 | R | dn | |
| Pa_cip | PA14_29590 | 70-169 | CTGAAAAGCGACAGCAGCCTGAAGCAGGAACTGGAATTCAAGGACAAGTT GCAGGCGTTGATGGACAAGTACGGCATGACCCTGCACAACATCATCGCCA | SEQ ID NO: 873 | R | dn | x |
| Pa_cip | PA14_00810 | 616-715 | GCCCTCGGCGCGACTGCGGGCGATCCGCACGCTCAGCGGCAACGGCATCC CGGTGGGCGTGCTCTGCTCGCCGATGATCCCGATGGTCAACGACATGGAG | SEQ ID NO: 874 | R | up | |
| Pa_cip | PA14_04310 | 471-570 | CGGTCTACCGCGAAGGCGTGCTGACCGACAACGGCAATATCATCCTCGAC GTGCACAACCTGCGCATCGACAGCCCGGTGGAACTGGAAGAGAAGATCAA | SEQ ID NO: 875 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Pa_cip | PA14_05620 | 409-508 | TGGACGACGGCGGTGACCTGACCGAGATCCTGCACAAGAAATACCCGCAG ATGCTCGAGCGCATCCACGGCATCACCGAAGAGACCACCACCGGGGTCCA | SEQ ID NO: 876 | R | up | |
| Pa_cip | PA14_07770 | 62-161 | TGGCTCTGCAGCCGGTCGCAGCATTGACTGTACAGGCCGCCGATCAGTTC GACTGCAAGGTATCGGCCACCGGCGGCTGGGATTGCTCCCCGCTGCAGAA | SEQ ID NO: 877 | R | up | |
| Pa_cip | PA14_07960 | 2-101 | TGGACAAGAGCACCCAGATCCCGCCCGACAGCTTCGCCGCTCGCCTCAAG CAGGCCATGGCGATGCGCAACCTGAAGCAGGAAACCCTCGCCGAAGCGGC | SEQ ID NO: 878 | R | up | x |
| Pa_cip | PA14_07970 | 4-103 | GCTGACCTTGCCGATCACGCCAACGAACTGGTCCTGGCTCGCCTCGACGG CCTCCTGGCGGCGCGCCCGGCGCTGGCCATCCGCGAGTCCGCGGAAGACT | SEQ ID NO: 879 | R | up | |
| Pa_cip | PA14_07980 | 130-229 | CGCGGCCACCGTGGCAGCCGGGTGATCCTCGACCGTGTGGCGGAGGTCGA TCGCCTGGTAAATCGCCTACCCGAGGAACTGAAGAACGTGGTGGTGGAGC | SEQ ID NO: 880 | R | up | x |
| Pa_cip | PA14_07990 | 108-207 | CCGCAGACACTGACGGAAATGCCGCTCTGGGTACTGATCCTGCTCGCCGC GCTGGGCGGCGTCAGCGGCGAGATGTGGCGTGCCGACAAGGCCGGTCTCG | SEQ ID NO: 881 | R | up | |
| Pa_cip | PA14_08180 | 13-112 | GCTCTGCTCCTGCCGGCCGTGTTGCTGGTCCTGCTGGCCGGCGCCTTGCT CGGCGGCGGCCTGGTTGCCCGCCACTATCGTCCGCAACTGGAGGAGGCCC | SEQ ID NO: 882 | R | up | |
| Pa_cip | PA14_12010 | 131-230 | CCGCCCGCGCGGAGTTGTCCCACGCCAACGAGCAGGACCTCGCCGCCGGC CGCGCCAATGGCCTGGAGCCGGCGATGCTGGACCGCCTGGCGCTGACCCC | SEQ ID NO: 883 | R | up | |
| Pa_cip | PA14_12550 | 291-390 | GATGGCGGTCGCCGAGCACGACCGCGACTGCGACGCCGAGACCCGCGACG CCTGGCGCGACGTGATGGGTCGCGGCATCGCCGTGATCAAGTCGTACTAC | SEQ ID NO: 884 | R | up | |
| Pa_cip | PA14_13030 | 536-635 | CGTTCCCCTACCGCCTGCTGCACATGTCGGTCGCCGCGTTCCTCGCCACC GCCTTCTTCGTCGGCGCCTCGGCCGCCTGGCACCTGCTGCGCGGGCGCGA | SEQ ID NO: 885 | R | up | |
| Pa_cip | PA14_13520 | 363-462 | CACCGCTGGCCGGACGACTATTTCTACGGCCCCGGCGACCTGGCGCGGAC CACTTCCTGGAACAACTCCACCGAGATCGGCCTGAACTACAAGCTCGATC | SEQ ID NO: 886 | R | up | |
| Pa_cip | PA14_13530 | 1282-1381 | GCCCCACGGCGGCACCTTCGCCCTCACCGCGGTACTGATCTCGGCGCTCT CCTCGACCTCGCCGAATCCCGGCCGGTTGTCGCTGCAACTCACCCTCGGG | SEQ ID NO: 887 | R | up | |
| Pa_cip | PA14_14500 | 313-412 | CGGCGCTGCTGGTGGCGATCCTGGTGGCCTGGCTGAGCCTGTTCCTGGCG CCCCAGGGCATCAACCAGTTCGCCCTGCTGTTGAACAAGCAGGATACCCT | SEQ ID NO: 888 | R | up | |
| Pa_cip | PA14_14600 | 645-744 | GTCGGTGGGCGAGCCGAAGGAAGAGATGATCCGCGTGCTCGATTTCCTGC CGCCGCAGATGCCGGCCGACAAGCCGCGCTACCTGATGGGCGTGGGCAAG | SEQ ID NO: 889 | R | up | |
| Pa_cip | PA14_14610 | 197-296 | TCACTTCCGGCGGTATCGCCGGCAAGGTGACCAAGGTCGCCGACGATTTC GTCGTCGTCGAGGTTTCCGACAACGTCGAGCTGAAGTTCCAGAAGGCCGC | SEQ ID NO: 890 | R | up | |
| Pa_cip | PA14_14680 | 299-398 | ACTTCGCCGTGAGCATCGCCTGCAAGTACAAGGGCCGCCTGGAGCACGCC GTGGTCCTCGACCCGGTACGCCAGGAAGAATTCACCGCCAGCCGCGGTCG | SEQ ID NO: 891 | R | up | x |
| Pa_cip | PA14_15310 | 33-132 | CGACGACGTCCTTCTGATCCCCGGTTATTCCGAAGTCCTGCCCAAGGACG TGAGTTTGAAAACTCGCCTGACCCGCGGCATCGAACTGAACATCCCGCTG | SEQ ID NO: 892 | R | up | |
| Pa_cip | PA14_15740 | 1382-1481 | CGACTTCGCCTCGGTGCAGCGCGACAACCCGGAAATGGAGCGACGTTGCC AGGAAGTGATCGACCGCTGCTGGCAGCTCGGCGAGCGCAACCCGATCAGC | SEQ ID NO: 893 | R | up | |
| Pa_cip | PA14_15960 | 62-161 | AGCTGACCGAGGACAACATCAAGGACACTCTGCGCGAAGTGCGCATGGCC CTGCTCGAGGCCGACGTGGCCCTGCCGGTGGTCAAGGACTTCGTCAACAA | SEQ ID NO: 894 | R | up | |
| Pa_cip | PA14_15970 | 60-159 | CGTGACCAACAGCCGCAATGCGCGCGATGGTCGCTTCGTCGAGCGCATCG GTTTCTTCAACCCGGTTGCGACTGGTGGCGAAGTGCGTCTGTCCGTCGAC | SEQ ID NO: 895 | R | up | |
| Pa_cip | PA14_15980 | 241-340 | GCCCGCACCTTCACCGGTTACGAGATCTGCATCCCGCGTAGCGAGTTGCC CTCTCTCGAGGAAGGTGAGTACTACTGGCACCAGCTGGAAGGCCTGAAGG | SEQ ID NO: 896 | R | up | |
| Pa_cip | PA14_15990 | 417-516 | CGATTATGTCCTGTCCGGCGGTGAGTTGCCGGCCATGGTGCTGGTCGATG CAGTGACGCGGTTGCTGCCCGGTGCATTGGGTCATGCAGATTCCGCCGAG | SEQ ID NO: 897 | R | up | |
| Pa_cip | PA14_16010 | 21-120 | AATCCTGCGTCGCACCGAGCTTTCCGAAACCCGTGTGACCAAGGCGGTAT TCCCGCCCACCACCAATCACCACAACACCCTGTTCGGCGGGACTGCGCTG | SEQ ID NO: 898 | R | up | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Pa_cip | PA14_17530 | 347-446 | CAGCCGGACACCGGCGAGCAGGCCCTGGAAATCACCGACATGCTGGTGCG CTCCAACGCGGTCGACGTGATCATCGTCGACTCCGTGGCCGCGCTGGTAC | SEQ ID NO: 899 | R | up | |
| Pa_cip | PA14_17540 | 141-240 | CGACCGCCTGGCCGAGGAAGGTCTGCTCGACGAATCCCGCTATCTCGAAA GCTTCATCGCCAGTCGCGCCCGTAGCGGCCATGGGCCGTTGCGCATCCGT | SEQ ID NO: 900 | R | up | x |
| Pa_cip | PA14_18690 | 197-296 | AGGCGCGCAACGTCGAGGTGATCGGCGTTTCCATCGACTCCCACTTCACC CACAACGCCTGGCGCAACACCCCGGTGGACAAGGGCGGCATCGGCGCCGT | SEQ ID NO: 901 | R | up | |
| Pa_cip | PA14_18750 | 271-370 | CCAGGCCTGCGACGACATCCGCAACAACGGCGGCCAGGTCACCCGCGAAG CCGGGCCGATGAAGCACGGTACCACCGTGATCGCCTTCGTGACCGACCCG | SEQ ID NO: 902 | R | up | |
| Pa_cip | PA14_19940 | 417-516 | CAGCCGCTACCGCGTGGCCGGCACCGAGGTCTATCGCCTGCGCGGCAGCC AGGCCGGCAAGCCCTACCACGCGCTCTACCTGCTCGACGGTCCCCAGGTG | SEQ ID NO: 903 | R | up | |
| Pa_cip | PA14_19950 | 44-143 | GTTTGTTCATGGACAAGGCTGAAGCCGATCGTTACGACAAGATGCTGGAG CTGGCGGAAACGCTGGCCGAGGTGCTGCAGAAGGCGGTGCCGTCGCTGAA | SEQ ID NO: 904 | R | up | x |
| Pa_cip | PA14_23250 | 51-150 | GGACGGTACGCTGCGGTTGCTGGATCAGCGCCTGCTGCCCCAGGAGGAGG TCTGGCTCGAACACGAGTCGGCGGCCGAGGTGGCCAAGGCCATTCGCGAT | SEQ ID NO: 905 | R | up | |
| Pa_cip | PA14_23900 | 52-151 | ATCGTCGTTTCCAGCCTGATCAGTCTGAGTCGCGGCTTCGTCAAGGAAGC CTTGTCCCTGCTTACCTGGATAGTCGCCGGCGCGGTGGCCTGGATGTTCG | SEQ ID NO: 906 | R | up | |
| Pa_cip | PA14_23920 | 457-556 | TTCGCCGCGGTTTCCTGCGTGCACGACCGTTGCGTCGGCGGCTACGCGGT GGTGGCGATGATCACCGGCCATGGCATCGTCGGTTTCCGCGACCCCAATG | SEQ ID NO: 907 | R | up | |
| Pa_cip | PA14_25160 | 298-397 | TCGAGGAATCCTGCCGTATCAATCCCGCCTTCTTCAATCCTCGCGCCGAC TACCTGTTGCGCGTGCGCGGCATGAGCATGAAGGACATCGGCATCCTCGA | SEQ ID NO: 908 | R | up | x |
| Pa_cip | PA14_25620 | 404-503 | CCATGACCCCGAAGTATGTCAGCACCCGGCTGGATTCGTCGTCGAAGACG AGCCGGAGTCGAGCGAAGTCGAGGACAAGCGTCCTAATCCGTTCAGCGTA | SEQ ID NO: 909 | R | up | |
| Pa_cip | PA14_25630 | 40-139 | GACATGCGTCGTTCCCACGATGCGCTCGAGTCCAATGCTCTGTCCGTGGA AAAGAGCACCGGTGAAGTCCACCTGCGCCACCACGTATCCCCGGACGGCT | SEQ ID NO: 910 | R | up | |
| Pa_cip | PA14_27050 | 695-794 | CTGCGCGTCGACCGCCACCTGGTGCTGGACAATCGCGCCGACATGGCCTG GTACGTGCGCCGCGATGCCAGCACCCTGCGCGCGACCATCGACCGCTTCC | SEQ ID NO: 911 | R | up | |
| Pa_cip | PA14_27370 | 659-758 | GCCGCCAAGACCCAGACCGTGGCGCGCATCGAGCAGGTCCACCTGATGGT CCATGCCGACCAGAAGGCCGGTTCGATCCAGCGTCTGCTGGAAGTCGAGC | SEQ ID NO: 912 | R | up | x |
| Pa_cip | PA14_27980 | 536-635 | CGCCATCCTCGAAGGGCTCTCGCCCAAGGAAAACCGCGAGGTGCCGCCGC TGCGCTACGAGGTCGCGGCGCAATTGAAGAAGGACTTCCCGGACCTGGAG | SEQ ID NO: 913 | R | up | |
| Pa_cip | PA14_28450 | 8-107 | CACTACTGATCGCCGCCGGCGTTGCCGCTCTTTCCAGCACCGCCATGGCC GCCAAACTGGATGAAAAGGTTCCCTACCCGAANNNNNNNNNNNNNNNNNN | SEQ ID NO: 914 | R | up | |
| Pa_cip | PA14_28650 | 1644-1743 | CCGATTTCGCCGCCGAGGTGGTGCGGATCCTCGGGGAAAGCGGATTCCGT GCCAAGTCCGACTTGAGAAACGAGAAGATCGGCTTTAAAATCCGCGAGCA | SEQ ID NO: 915 | R | up | |
| Pa_cip | PA14_28660 | 246-345 | GAAGCAGGCTGCGGTCGCCAAGAAGAACCAGAAGCAGGCGCAGGTCAAAG AAATCAAGTTTCGTCCAGGGACGGAAGAAGGGGATTACCAGGTAAAACTA | SEQ ID NO: 916 | R | up | |
| Pa_cip | PA14_30180 | 761-860 | AGGCGACCATGATGAAGATTTCCCACCCGATCGTCTTCGGACATGCGGTG AGCGTCTACTACAAGGACGTCTTCGACAAGTGGGGCCAACTCTTCGAAGA | SEQ ID NO: 917 | R | up | x |
| Pa_cip | PA14_30190 | 348-447 | AACGTGGCCCTGCGCCAGCAACTCGATCTCTACGTCTGCCAGCGCCCGGT ACGCTGGTTCGAAGGCGTGCCCAGCCCGGTGAAGAAGCCCGGCGACGTGG | SEQ ID NO: 918 | R | up | |
| Pa_cip | PA14_30240 | 55-154 | AACACCATGTTCCGTGTGGAGTTGGAAAATGGGCACGTCGTCACCGCGCA CATCTCCGGCAAAATGCGCAAGAACTACATCCGCATCCTCACCGGCGACA | SEQ ID NO: 919 | R | up | |
| Pa_cip | PA14_52480 | 260-359 | ACTTCACTGCAAGGCGCTTCCGAAACGGTGGACGTGCAAACGGGATTCCA CCTGTATCGCGGTCTGTTCATCACGCGCGTTGTTGCCCGGCGAACCGCAG | SEQ ID NO: 920 | R | up | |
| Pa_cip | PA14_52510 | 85-184 | AACGCCTTGCTGGGAGGCTTCGGCGGCGCCATCTTCTTTGTCGTGTTCGC CCGTGACTACAACGCCCTGACCCGCCTCGGCTACCTGCTGGTGTCCTGGG | SEQ ID NO: 921 | R | up | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha- se 2?[e] |
|---|---|---|---|---|---|---|---|
| Sa_levo GeneID = NC_ 002745 | SA0013 | 1180-1279 | AAAAAGCCAGAGTTAAGAGAGCGATTTATTACATCAGATGATGCTTGGGA TATGATGACATCTAAGACAACCGTAGTGATTGTTGATACGCATAAACCGG | SEQ ID NO: 922 | C | | x |
| Sa_levo | SA0441 | 183-282 | CAAACGTGTGGTAATAGAGAACAGTTGGTTTCACCTATTACACCTATGGG AGGCAGTGCGGATTCGTACATTCCATATCCAGTTGAAGTTGAAGTTGGCG | SEQ ID NO: 923 | C | | x |
| Sa_levo | SA0448 | 1526-1625 | ATGGTTACTGGGCAACCTAAACCTATTTTCCCAAGATTGGATAGCGAAGC GGAAATTGCATATATCAAAGAATCAATGCAACCGCCTGCTACTGAAGAGG | SEQ ID NO: 924 | C | | x |
| Sa_levo | SA0490 | 501-600 | TGGCTTTTGGGTAGCTGGCACTGAAGCTAATAATGCAACAGATTATAGAA ATCTAGAAGCGGACATGTCATTGGCTATTGTAATTGGTAGCGAAGGACAG | SEQ ID NO: 925 | C | | x |
| Sa_levo | SA0491 | 302-401 | TACAGTTGTAACAAGTGATATGAGTGAGCAACATGCTATCTTTGGATCAG GTGCATATAGAATATCATCTCGCGAAATGTGGAGAGATTTAAAAGAAAAT | SEQ ID NO: 926 | C | | |
| Sa_levo | SA0811 | 226-325 | TATGAAGCGAACGTAAAAAGCTATGTTGATCCTATCCCGCAAGCACTTAT TTTAACAGCAATCGTTATCGCCTTTGCGACAACAGCCTTTTTCTTAGTAT | SEQ ID NO: 927 | C | | x |
| Sa_levo | SA0869 | 572-671 | TCCAATCCGTACATTAAGTGCAAAAGGTGTGGGTGGTTTCAATACAATTC TTAAAGAAATCGAAGAGCGTGCACCTTTAAAACGTAACGTTGATCAAGTA | SEQ ID NO: 928 | C | | |
| Sa_levo | SA1055 | 1574-1673 | CATAAAACGACAGACTTATTAAAATGTCACTATTGTGGTTACCAAGAGAC GCCACCGAATCAATGTCCAAATTGTGAGAGTGAACACATTCGACAAGTAG | SEQ ID NO: 929 | C | | |
| Sa_levo | SA1077 | 1584-1683 | TTGATGTGCCATCTAAATTAACTCAGGCAATTGAAACAGCATTAGGTGCT TCATTACAACATGTCATTGTAGATTCAGAAAAAGATGGACGCCAGGCTAT | SEQ ID NO: 930 | C | | x |
| Sa_levo | SA1135 | 147-246 | GCATCAAAAACAAGCAGTAAACTTTCAAAATTACGGGAAACAAAATGCGC TAGAACAGTCGGAACATACCATTCAAAGTATAGAAGCAGAAATAAATACA | SEQ ID NO: 931 | C | | x |
| Sa_levo | SA1288 | 754-853 | GACCGCAACAATTATATTTAGCGGAAACTATATTAGATCAGCTCATGCAT AGTGAAAAAGCAATGATTGAAGCATCACTAGGCAGTGGTAAATCATTAGC | SEQ ID NO: 932 | C | | x |
| Sa_levo | SA1296 | 540-639 | GTAACTATAGTGATGCGATTCGCTTATACGATGAAATTAATGAAGATGAA ATGACTTCAGAAGATTATCTCAAAAAAGCCATTTCTTACGATAAAAATGA | SEQ ID NO: 933 | C | | |
| Sa_levo | SA1394 | 596-695 | AAATTGGTAAATCATTCCGTAATGAAATCACTCCAGGTAACTTCATTTTC AGAACAAGAGAATTTGAACAAATGGAACTTGAATTCTTCTGTAAACCTGG | SEQ ID NO: 934 | C | | |
| Sa_levo | SA1445 | 90-189 | TTATCGAACATTAGATGAACGAGGATATAATGCCGTAAACCAAATTGTAG GTTATTTATTATCAGGTGACCCTGCGTATATTCCACGCCAAAATGAAGCA | SEQ ID NO: 935 | C | | x |
| Sa levo | SA1525 | 1358-1457 | ACACATGCGGCAGGAATTATTATTAATGACCATCCATTATATGAATATGC CCCTTTAACGAAAGGGGATACAGGATTATTAACGCAATGGACAATGACTG | SEQ ID NO: 936 | C | | x |
| Sa_levo | SA1526 | 870-969 | GATATTGCGCAAGATTTTGGTGGCGGTGGTCATCCGAATGCGTCAGGAGT TTCAGTGAACAGCTGGGATGAATTTGAGCAACTTGCTACAGCTTTACGCA | SEQ ID NO: 937 | C | | |
| Sa levo | SA1579 | 1311-1410 | ACAATGACAACTGTTCCTGAAGAAGAGCTACCATTGTTGTTACCTGAAAC AGATGAAATCAAGCCATCAGGGACTGGTGAGTCTCCACTAGCTAATATTG | SEQ ID NO: 938 | C | | x |
| Sa_levo | SA1654 | 427-526 | TTTGGAGTCAGTGCATTAATTTTTCCATATGTTGGTTTACGCTTAAGATG GCAATGGTATCAATCGGGACTTAAAACATGGCAAGTTAATTTAATATCAT | SEQ ID NO: 939 | C | | |
| Sa levo | SA1682 | 685-784 | ACTATAGCGAAGAACGTCCTATTACAAAAAAACATATTCACCAACAGAAT AGAAAGAAAATACTTTTCAGAGAAGTAGTTCAGACGACTAGACAAGCTTA | SEQ ID NO: 940 | C | | |
| Sa levo | SA1687 | 282-381 | TTTAATATTTCCGCAGCGACGCCAGTAGTTATTATGTCTATTTTAAGTTT TATTATGCTAGTCATTTTGACGATGATTAGTGCATTGGTTAAACCAGTAA | SEQ ID NO: 941 | C | | x |
| Sa_levo | SA1886 | 282-381 | CAATTGGCACAAGCTTACTTGAGACATGTAAACCCTAAAGTAATTGCCGT CACAGGGTCTAATGGTAAAACAACGACTAAAGATATGATTGAAAGTGTAT | SEQ ID NO: 942 | C | | x |
| Sa_levo | SA2055 | 211-310 | TTCCAAAAGAGAATTGGTGGGTATTTATCGTCTTATTACTCTTAGTCGGT AATGTCGAAGTGACAGGATTTAAAATGCTTAAAAAAGATCTAAAAGGCGT | SEQ ID NO: 943 | C | | |
| Sa_levo | SA0269 | 688-787 | ATTAAGGTTAATGGTGAAAAGTACAAAGTTAGACCTGTCACGTTAACACT TAGCAGAGCTGACACTAAAAAAATTACATTAGCTGTATTAGAAGAAGCTA | SEQ ID NO: 944 | R | dn | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Sa_levo | SA0682 | 100-199 | TTCTGGGAAAGGTTTAGTTATTATGGCATGCGTGCCCTACTCATTTTCTA CATGTACTTTGCCGTAACAGATAATGGCCTTGGAATTGATAAAACAACAG | SEQ ID NO: 945 | R | dn | |
| Sa_levo | SA0730 | 115-214 | AAATATCCAACGACTCAAATCGAAGCGAGTGGCTTAGATGTTGGACTACC TGAAGGACAAATGGGTAACTCAGAAGTTGGTCATATGAATATCGGTGCAG | SEQ ID NO: 946 | R | dn | |
| Sa_levo | SA1021 | 288-387 | CGCTAATTTAACTAAAGAATGTACAGTAATCGGTGTTTCAAATCGTATTG AGATTTGGGATAGAGAAACTTGGAATGATTTCTATGAAGAATCTGAAGAA | SEQ ID NO: 947 | R | dn | |
| Sa levo | SA1022 | 294-393 | TTACGACTTGGGTGTTTCAAGCCCACAACTCGACATTCCAGAACGAGGAT TCAGTTATCACCATGACGCAACATTAGACATGCGTATGGACCAAACACAA | SEQ ID NO: 948 | R | dn | x |
| Sa_levo | SA1023 | 326-425 | AGAATTCTTCTTATGAACGCATATACGAAAAGGCTAAGAAACAGGGGATG AGCCTTGAGAACGATAATGTAAAGGTAGTGCGTAGTAATGGCGAAGCAAA | SEQ ID NO: 949 | R | dn | x |
| Sa_levo | SA1987 | 541-640 | GTGGACCTTTAGGTGGTGCCATTGATGTATTGGCAGTCATAGCTACAGTA ACAGGCGTTGCTGCAACATTAGGTTTCGGTGCATTGCAAATAAACGAAGG | SEQ ID NO: 950 | R | dn | |
| Sa_levo | SA0128 | 188-287 | TACCGGAAGCGATGAGGATGTCAGTCCGTAATAATGGCGGTGGTCATTTT AACCATTCATTATTCTGGGAAATACTATCACCTAATTCTGAAGAAAAAGG | SEQ ID NO: 951 | R | up | |
| Sa_levo | SA0480 | 150-249 | ACACGATTCACTAATGAACATGGTTATGAAATCGAAAGTAAACGTGGTGG TGGTGGTTACATCCGAATCACTAAAATTGAAAATAAAGATGCAACAGGTT | SEQ ID NO: 952 | R | up | |
| Sa_levo | SA0481 | 279-378 | TTTGAAAGATATTGCACATGTTGGTAAATTTGGGTGTGCTAATTGTTATG CAACATTTAAAGATGACATCATTGATATCGTCCGCAGAGTTCAAGGTGGA | SEQ ID NO: 953 | R | up | |
| Sa_levo | SA0482 | 744-843 | CGACAAAAGTTAGACACTTATAATCAATTAGAAACACAAGACCGTGTTTT TCGCTCGCTAGGTATTTTACAAAACTGTAGAATGATAACTATGGAAGAGG | SEQ ID NO: 954 | R | up | |
| Sa_levo | SA0685 | 274-373 | GCGGGTCGCACGATATCAGAAGAGTATAATGTCCCTTTATTAATGAAGTT TGAGTTACATGGAAAAAACAAAGACGTTATTGAATTTAAGAACAAGGTGG | SEQ ID NO: 955 | R | up | x |
| Sa_levo | SA0686 | 559-658 | AGCTAGTGTCATGTTTCTTATTAGAAGTGGATGACAGCTTAAATTCAATT AACTTTATTGATTCAACTGCAAAACAATTAAGTAAAATTGGGGGCGGCGT | SEQ ID NO: 956 | R | up | x |
| Sa_levo | SA0687 | 18-117 | GAACACACAAGAAGATATGACGAATATGTTTTGGAGACAAAATATATCTC AAATGTGGGTTGAAACAGAATTTAAAGTATCAAAAGACATTGCAAGTTGG | SEQ ID NO: 957 | R | up | x |
| Sa_levo | SA0713 | 492-591 | GGTTTAGGTAATCCTGAAGAATATAAAGATTTAGTAGTAAGTGTTCGAGT TGGTATGGAAATGGATAGAAGTGAATTACTTAGAAAACTTGTAGATGTGC | SEQ ID NO: 958 | R | up | x |
| Sa_levo | SA0714 | 2434-2533 | TGGTCTTGGATACGTCACATTAGGTCAACAAGCTACAACGTTATCAGGTG GTGAGGCTCAACGTGTGAAACTTGCATCTGAACTTCATAAACGTTCAACT | SEQ ID NO: 959 | R | up | |
| Sa_levo | SA0835 | 1313-1412 | AAAGCGCACTTAAAAATGAATCTGACAATGCGAGCAAACAGAGATTACAA GAACTACAAGAAGAGCTTGCCAATGAAAAAGAGAAACAAGCAGCACTTCA | SEQ ID NO: 960 | R | up | |
| Sa_levo | SA1128 | 605-704 | TCGGTAATCCAGAGACTACACCAGGTGGACGTGCATTAAAATTCTATAGT TCAGTAAGACTAGAAGTACGTCGTGCAGAACAGCTTAAACAAGGACAAGA | SEQ ID NO: 961 | R | up | x |
| Sa_levo | SA1174 | 321-420 | TCCATTACCTGAACACTTAACATCGACACATAATAGCGACATATTCATAT TAAACGTCGTAGGCGACAGTATGATTGAGGCTGGTATATTAGACGGAGAC | SEQ ID NO: 962 | R | up | |
| Sa_levo | SA1175 | 178-277 | GCTCACTCGGAACAAGTGTACGAAATGACTGACCATCAAATTAAGAACAA TACGATAAATAAAGCATACGAACATAAAGACCCTACAAACAATAGCGAAC | SEQ ID NO: 963 | R | up | |
| Sa_levo | SA1180 | 499-598 | ATTGATGAAGATGCCGTCAATATTTTAATTAGTCATCTGACTGTTCAAGG TGGAAAGACATCTGATTCTGAAAGACCATTAACTATTGGAACGGTTGAAT | SEQ ID NO: 964 | R | up | x |
| Sa levo | SA1181 | 133-232 | GATGCAATGACTTATGCCTTGTTTGGTAAAGCATCAACTGAACAAAGAGA AGAAAATGATTTGAGAAGTCATTTCGCTGATGGTAAACAGCCGATGTCAG | SEQ ID NO: 965 | R | up | x |
| Sa levo | SA1196 | 864-963 | AGCAGAGTTCGAGCAAGAAAAAAAGTGGCAAGAACGATACATTTTGCCTT TGGCTATAGTGATGAAGGCGGTGTACATAAGCAATATACTTTGAAAGATC | SEQ ID NO: 966 | R | up | |
| Sa levo | SA1198 | 144-243 | AATAACAGTGCCAGGCAAAAATGATGAAGTACAACGCTGTATTACTGCTC ATGTTGATACTTTAGGTGCAATGGTTAAAGAAATTAAAGAAGATGGTCGC | SEQ ID NO: 967 | R | up | x |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Pha-se 2?[e] |
|---|---|---|---|---|---|---|---|
| Sa_levo | SA1221 | 3-102 | GAAAAAATGGCAATTTGTTGGTACTACAGCTTTAGGTGCAACACTATTAT TAGGTGCTTGTGGTGGCGGTAATGGTGGCAGTGGTAATAGTGATTTAAAA | SEQ ID NO: 968 | R | up | |
| Sa_levo | SA1315 | 49-148 | GCATGCGGTGCAGCAGCGCCAGATATATATGATTACGACGACGAAGGTAT TGCTTTCGTAATCCTTGACGATAACCAAGGTACTGCAGAAGTACCTGAGG | SEQ ID NO: 969 | R | up | |
| Sa levo | SA1411 | 8-107 | CAGATAGGCAATTGAGTATATTAAACGCAATTGTTGAGGATTATGTTGAT TTTGGACAACCCGTTGGTTCTAAAACACTAATTGAGCGACATAACTTGAA | SEQ ID NO: 970 | R | up | |
| Sa_levo | SA1738 | 209-308 | GGCTACACGAGGCGCTACAATATGCCCAACCTGTAGAAGTTAAATTTTAT AATAATGGCTTTGTAGATTCAGTACGCTTAACCATTTATCGTATTGATGC | SEQ ID NO: 971 | R | up | |
| Sa_levo | SA1759 | 134-233 | TGTGGGGAAATGCAAAAGATGCAATCAATAACGATTTTAAAAACATGGCA ACAGTATATGAAAACACACCATCGTTTGTTCCACAAATAGGTGATGTGGC | SEQ ID NO: 972 | R | up | |
| Sa_levo | SA1764 | 1165-1264 | AGTGATACACCGCCAGAAAATCCAGTCAATGATATGCTTTGGTATGATAC AAGTAACCCTGATGTTGCTGTCTTGCGTAGATATTGGAATGGTCGATGGA | SEQ ID NO: 973 | R | up | |
| Sa_levo | SA1765 | 686-785 | GTCGGCGGTGACTTTGTGATATCCAATCTTGGCGAAGGATATAAAGCAAC TAATTTTCCTGATGCAAAAGGTTGGGTTGGTGCTGGCACGAAACGAGGGC | SEQ ID NO: 974 | R | up | |
| Sa_levo | SA1811 | 696-795 | AAAGGCACTCCAGAGTTCAAAGATATGCTTAAAAACTTGAATGTAAATGA TGTTCTATATGCAGGTCATAATAGCACATGGGACCCTCAATCAAATTCAA | SEQ ID NO: 975 | R | up | |
| Sa_levo | SA1898 | 25-124 | TCATTAGCAGTAGGTTTAGGAATCGTAGCAGGAAATGCAGGTCACGAAGC CCATGCAAGTGAAGCGGACTTAAATAAAGCATCTTTAGCGCAAATGGCGC | SEQ ID NO: 976 | R | up | |
| Sa_levo | SA2097 | 268-367 | GCTAATAATTGGGCTGCTGCTGCACAAGGTGCTGGATTCACAGTAAATCA TACACCTTCTAAAGGCGCTATCCTACAATCTTCTGAAGGACCATTTGGTC | SEQ ID NO: 977 | R | up | |
| Sa_levo | SA2420 | 962-1061 | GTCGTTGCAACAGCAGATCACTCTACTGGTGGTCTAACAATTGGTAAAGA TAAAGGATACGAATGGAATCCTCAACCGATTAAATCGATGAAACACTCTG | SEQ ID NO: 978 | R | up | |
| Sa_levo | SAS009 | 34-133 | CAAGAATTCCAAGAGATACTTAATAGTGGCATTCATCCTGAATGGCTTTA TTGTGCAAAGGCTAATCTTGTTTTAGAGCCTGCTTATACTGGCGAAGGCA | SEQ ID NO: 979 | R | up | |
| Sa_levo | SAS016 | 6-105 | TATTTATCGACAGTATCACCATGAAGGCGCACCAGTTTATGAAATTATAA CCAAAACGTTTCAGCATGTTTCAATTAAATGTGACGATTCATTTAGTGAT | SEQ ID NO: 980 | R | up | |
| Cpase_ ESBL | KPC | 314-413 | ACCCATCTCGGAAAAATATCTGACAACAGGCATGACGGTGGCGGAGCTGT CCGCGGCCGCCGTGCAATACAGTGATAACGCCGCCGCCAATTTGTTGCTG | SEQ ID NO: 981 | carba pene mase | | |
| Cpase_ ESBL | NDM | 112-211 | CAAATGGAAACTGGCGACCAACGGTTTGGCGATCTGGTTTTCCGCCAGCT CGCACCGAATGTCTGGCAGCACACTTCCTATCTCGACATGCCGGGTTTCG | SEQ ID NO: 982 | carba pene mase | | |
| Cpase_ ESBL | OXA48 | 413-512 | TGCTACATGCTTTCGATTATGGTAATGAGGACATTTCGGGCAATGTAGAC AGTTTCTGGCTCGACGGTGGTATTCGAATTTCGGCCACGGAGCAAATCAG | SEQ ID NO: 983 | carba pene mase | | |
| Cpase_ ESBL | IMP_A | 37-136 | GAAGAAGGTGTTTATGTTCATACATCGTTCGAAGAAGTTAACGGTTGGGG TGTTGTTTCTAAACACGGTTTGGTGGTTCTTGTAAACACTGACGCCTATC | SEQ ID NO: 984 | carba pene mase | | |
| Cpase_ ESBL | IMP_B | 45-144 | GAAAAGTTAGTCAATTGGTTTGTGGAGCGCGGCTATAAAATCAAAGGCAC TATTTCCTCACATTTCCATAGCGACAGCACAGGGGGAATAGAGTGGCTTA | SEQ ID NO: 985 | carba pene mase | | |
| Cpase_ ESBL | IMP_C | 45-144 | GAAAAGTTAGTCACTTGGTTTGTGGAACGTGGCTATAAAATAAAAGGCAG TATTTCCTCTCATTTTCATAGCGACAGCACGGGCGGAATAGAGTGGCTTA | SEQ ID NO: 986 | carba pene mase | | |
| Cpase_ ESBL | IMP_D | 1-100 | TATGCATCTGAATTAACAAATGAACTTCTTAAAAAAGACGGTAAGGTACA AGCTAAAAATTCATTTAGCGGAGTTAGCTATTGGCTAGTTAAGAAAAAGA | SEQ ID NO: 987 | carba pene mase | | |

TABLE 9-continued displays the initially selected responsive and control genes for each pathogen-antibiotic pair disclosed herein, and all probes for carbapenemase and ESBL gene family detection, including probe sequences, and also 12fc thresholds used to generate each responsive and control gene list for each bug-drug pair. Also append reliefF ranking for the top 10 chosen.

| Strain/ Ab | GeneID[a] | Position[b] | Target Sequence[c] | SEQ ID NO: | Ctrl/ Resp | Up/ Dn[d] | Phase 2?[e] |
|---|---|---|---|---|---|---|---|
| Cpase_ ESBL | VIM | 477-576 | CTCTAGTGGAGATGTGGTGCGCTTCGGTCCCGTAGAGGTTTTCTATCCTG GTGCTGCGCATTCGGGCGACAATCTTGTGGTATACGTGCCGGCCGTGCGC | SEQ ID NO: 988 | carba pene mase | | |
| Cpase_ ESBL | CTXM15 | 259-358 | AGTGAAAGCGAACCGAATCTGTTAAATCAGCGAGTTGAGATCAAAAAATC TGACCTTGTTAACTATAATCCGATTGCGGAAAAGCACGTCAATGGGACGA | SEQ ID NO: 989 | ESBL | | |
| Cpase_ ESBL | OXA10 | 246-345 | CATAAAGAATGAGCATCAGGTTTTCAAATGGGACGGAAAGCCAAGAGCCA TGAAGCAATGGGAAAGAGACTTGACCTTAAGAGGGGCAATACAAGTTTCA | SEQ ID NO: 990 | ESBL | | |

Reverse complement sequences of select 100 mer target sequences are presented in SEQ ID NOs: 991-1876 of the accompanying Sequence Listing, with SEQ ID NOs: 1877-2762 presenting select "Probe B" sequences (without terminal tag sequences) and SEQ ID NOs: 2763-3648 presenting select "Probe A" sequences (also without terminal tag sequences).

Table legend:

[a]GeneID refers to reference genome as indicated, with alternate GeneID references in parentheses; when GeneID is NC_009648, reference is using what is currently referred to as "old_locus_tag";

[b]Position is listed relative to the start codon of that locus;

[c]100-mer target selected based on homology masking of full-length gene, used to design hybridization probes. Probe A is complementary to the first half; probe B is complementary to the second half of the target sequence;

[d]for responsive genes, listing whether they are predicted to be up-regulated ("up") or down-regulated ("dn") based on RNA-Seq results. Note that for all genes selected by reliefF, the direction of change expected from RNA-Seq matched that seen in NanoString® data;

[e]selected by reliefF as top 10 responsive feature, or by variation on geNorm algorithm as top ~10 control feature, and thus used in phase 2 experiments.

TABLE 10 every strain, MIC, CLSI class, and GoPhAST-R call, sorted by MIC. For phase 1, separate train and test.

| | | | | | | | | |
|---|---|---|---|---|---|---|---|---|
| KpMero_ Phase 1 | Species: | *K. pneumoniae* | | | | | | |
| | Drug: | meropenem | | | | | | |
| | Concentration treated: | 2 mg/L | | | | | | |
| | CLSI breakpoints (2018 M100) | | | GoPhAST-R class | | | | |
| | S≤ | 1 | mg/L | S | | | | |
| | I= | 2 | mg/L | R | | | | |
| | R≥ | 4 | mg/L | R | | | | |
| | Aggregate performance: Confusion matrix | | | | | | | |
| | | | Reference (MIC by CLSI) | | | | | |
| | | SPD | S | I | R | | | |
| | Prediction | S | 5 | 1 | 0 | | | |
| | | NS (I or R) | 0 | 0 | 6 | | | |
| PHASE 1 | | Broth microdilution | | GoPhAST-R | | CPase/select | | |
| STATUS: | Strain | MIC | class | Res_prob | class | ESBL | agreement | |
| Strains used for phase 1 testing (classifier validation) | RB274 | 0.5 | S | 0.026 | S | | concordant | S_concordant |
| | RB404 | 0.5 | S | 0.104 | S | | concordant | S_concordant |
| | RB419 | 0.5 | S | 0.014 | S | | concordant | S_concordant |
| | RB288 | 0.5 | S | 0.114 | S | | concordant | S_concordant |
| | RB587 | 1 | S | 0.066 | S | CTX-M-15 | concordant | S_concordant |
| | RB411 | 2 | I | 0.366 | S | | discordant | I_discordant |
| | RB400 | 8 | R | 0.992 | R | KPC (unknown type) | concordant | R_concordant |
| | RB271 | 16 | R | 0.722 | R | KPC-3 | concordant | R_concordant |
| | RB401 | 32 | R | 1 | R | KPC (unknown type) | concordant | R_concordant |
| | RB408 | 64 | R | 1 | R | VIM-27; CTX-M-15 | concordant | R_concordant |

TABLE 10-continued every strain, MIC, CLSI class, and GoPhAST-R call, sorted by MIC. For phase 1, separate train and test.

| | | | | | | | | |
|---|---|---|---|---|---|---|---|---|
| | RB579 | 64 | R | 0.994 | R | NDM-1; CTX-M15 | concordant | R_concordant |
| | RB596 | 64 | R | 0.898 | R | | concordant | R_concordant |
| Strains used for phase 1 testing (feature selection and classifier derivation) | RB039 | 0.5 | S | n/a | n/a | | | |
| | RB270 | 0.5 | S | n/a | n/a | | | |
| | RB275 | 0.5 | S | n/a | n/a | | | |
| | RB405 | 0.5 | S | n/a | n/a | | | |
| | RB410 | 0.5 | S | n/a | n/a | CTX-M15; OXA-10 | | |
| | RB417 | 1 | S | n/a | n/a | | | |
| | RB268 | 8 | R | n/a | n/a | s | | |
| | RB414 | 8 | R | n/a | n/a | CTX-M15 | | |
| | RB290 | 32 | R | n/a | n/a | KPC-3 | | |
| | RB285 | 64 | R | n/a | n/a | KPC-2 | | |
| | RB402 | 64 | R | n/a | n/a | KPC (unknown type) | | |
| | RB552 | 64 | R | n/a | n/a | OXA-10 | | |

| | | | | | |
|---|---|---|---|---|---|
| KpMero_ Phase2 | Species: | *K. pneumoniae* | | | |
| | Drug: | meropenem | | | |
| | Concentration treated: | 2 mg/L | | | |
| | CLSI breakpoints (2018 M100) | | | GoPhAST-R class | |
| | S≤ | 1 | mg/L | S | |
| | I= | 2 | mg/L | R | |
| | R≥ | 4 | mg/L | R | |
| | Aggregate performance: Confusion matrix | | | | |
| | | | Reference (MIC by CLSI) | | |
| | | SPD | S | I | R |
| | Prediction | S | 5 | 1 | 0 |
| | | NS (I or R) | 0 | 0 | 6 |

| PHASE 2 | | Broth microdilution | | GoPhAST-R | | CPase/select | | |
|---|---|---|---|---|---|---|---|---|
| STATUS: | Strain | MIC | class | probR | class | ESBL | agreement | |
| Strains used for phase 2 testing (classifier validation) | RB565 | 0.125 | S | 0.042 | S | | concordant | S_concordant |
| | RB483 | 0.25 | S | 0.002 | S | | concordant | S_concordant |
| | RB540 | 0.25 | S | 0 | S | | concordant | S_concordant |
| | RB541 | 0.25 | S | 0 | S | | concordant | S_concordant |
| | RB564 | 0.25 | S | 0 | S | | concordant | S_concordant |
| | RB039 | 0.5 | S | 0 | S | | concordant | S_concordant |
| | RB274 | 0.5 | S | 0 | S | | concordant | S_concordant |
| | RB041 | 0.5 | S | 0 | S | | concordant | S_concordant |
| | RB042 | 0.5 | S | 0.012 | S | | concordant | S_concordant |
| | RB273 | 0.5 | S | 0 | S | | concordant | S_concordant |
| | RB276 | 0.5 | S | 0.074 | S | | concordant | S_concordant |
| | RB280 | 0.5 | S | 0 | S | | concordant | S_concordant |
| | RB284 | 0.5 | S | 0 | S | | concordant | S_concordant |
| | RB554 | 0.5 | S | 0.746 | R | OXA-48 | discordant | S_discordant |
| | AR0034 | 2 | I | 0.682 | R | IMP-4 | concordant | I_concordant |
| | RB543 | 2 | I | 0.93 | R | CTX-M-15 | concordant | I_concordant |
| | RB780 | 2 | I | 0.656 | R | KPC-3 | concordant | I_concordant |
| | AR0044 | 4 | R | 0.72 | R | CTX-M-15 | concordant | R_concordant |
| | RB584 | 4 | R | 0.774 | R | CTX-M-15 | concordant | R_concordant |
| | AR0047 | 4 | R | 0.992 | R | | concordant | R_concordant |
| | AR0135 | 8 | R | 0.79 | R | VIM-1 | concordant | R_concordant |
| | RB291 | 8 | R | 0.968 | R | | concordant | R_concordant |
| | RB289 | 16 | R | 0.76 | R | KPC-3 | concordant | R_concordant |
| | RB551 | 16 | R | 0.762 | R | CTX-M-15; OXA-48 | concordant | R_concordant |
| | RB826 | 16 | R | 0.996 | R | NDM-1; CTX-M-15; OXA-10 | concordant | R_concordant |
| | RB401 | 32 | R | 0.998 | R | KPC (unknown type) | concordant | R_concordant |
| | AR0139 | 32 | R | 0.728 | R | NDM-1; CTX-M-15; OXA-10 | concordant | R_concordant |

TABLE 10-continued

| | | | | | | | | |
|---|---|---|---|---|---|---|---|---|
| every strain, MIC, CLSI class, and GoPhAST-R call, sorted by MIC. For phase 1, separate train and test. | | | | | | | | |
| | RB462 | 32 | R | 0.858 | R | KPC-2; OXA-10 | concordant | R_concordant |
| | RB480 | 32 | R | 0.772 | R | KPC-2 | concordant | R_concordant |
| | RB285 | 64 | R | 0.978 | R | KPC-2 | concordant | R_concordant |
| Strains used for phase 2 testing (feature selection and classifier derivation) | RB274 | 0.5 | S | n/a | n/a | | | |
| | RB404 | 0.5 | S | n/a | n/a | | | |
| | RB419 | 0.5 | S | n/a | n/a | | | |
| | RB288 | 0.5 | S | n/a | n/a | | | |
| | RB039 | 0.5 | S | n/a | n/a | | | |
| | RB270 | 0.5 | S | n/a | n/a | | | |
| | RB275 | 0.5 | S | n/a | n/a | | | |
| | RB405 | 0.5 | S | n/a | n/a | | | |
| | RB410 | 0.5 | S | n/a | n/a | CTX-M15; OXA-10 | | |
| | RB587 | 1 | S | n/a | n/a | CTX-M-15 | | |
| | RB417 | 1 | S | n/a | n/a | | | |
| | RB411 | 2 | I | n/a | n/a | | | |
| | RB400 | 8 | R | n/a | n/a | KPC (unknown type) | | |
| | RB268 | 8 | R | n/a | n/a | KPC-4 | | |
| | RB414 | 8 | R | n/a | n/a | CTX-M15 | | |
| | RB271 | 16 | R | n/a | n/a | KPC-3 | | |
| | RB401 | 32 | R | n/a | n/a | KPC (unknown type) | | |
| | RB290 | 32 | R | n/a | n/a | KPC-3 | | |
| | RB408 | 64 | R | n/a | n/a | VIM-27; CTX-M-15 | | |
| | RB579 | 64 | R | n/a | n/a | NDM-1; CTX-M15 | | |
| | RB596 | 64 | R | n/a | n/a | | | |
| | RB285 | 64 | R | n/a | n/a | KPC-2 | | |
| | RB402 | 64 | R | n/a | n/a | KPC (unknown type) | | |
| | RB552 | 64 | R | n/a | n/a | OXA-10 | | |
| KpCip_phase1 | Species: | *K. pneumoniae* | | | | | | |
| | Drug: | ciprofloxacin | | | | | | |
| | Concentration treated: | 1 mg/L | | | | | | |
| | CLSI breakpoints (2018 M100) | | | GoPhAST-R class | | | | |
| | S≤ | 1 | mg/L | S | | | | |
| | I= | 2 | mg/L | R | | | | |
| | R≥ | 4 | mg/L | R | | | | |
| | Aggregate performance: | | | | | | | |
| | Confusion matrix | | | | | | | |
| | | | Reference (MIC by CLSI) | | | | | |
| | | SPD | S | I | R | | | |
| | Prediction | S | 5 | 1 | 0 | | | |
| | | NS (I or R) | 0 | 0 | 0 | | | |
| PHASE 1 | | Broth microdilution | | GoPhAST-R | | | | |
| STATUS: | Strain | MIC | class | probR | class | | agreement | |
| Strains used for phase 1 testing (classifier validation) | RB041 | 0.03 | S | 0.004 | S | | concordant | S_concordant |
| | RB416 | 0.03 | S | 0.138 | S | | concordant | S_concordant |
| | RB268 | 0.125 | S | 0.042 | S | | concordant | S_concordant |
| | RB405 | 0.5 | S | 0.012 | S | | concordant | S_concordant |
| | RB418 | 1 | S | 0.074 | S | | concordant | S_concordant |
| | RB122 | 2 | I | 0.48 | S | | discordant | I_discordant |
| | RB400 | 32 | R | 0.868 | R | | concordant | R_concordant |
| | RB595 | 64 | R | 0.786 | R | | concordant | R_concordant |
| | RB039 | 128 | R | 0.906 | R | | concordant | R_concordant |

TABLE 10-continued every strain, MIC, CLSI class, and GoPhAST-R call, sorted by MIC. For phase 1, separate train and test.

| | | | | | | | |
|---|---|---|---|---|---|---|---|
| Strains used for phase 1 training (feature selection and classifier derivation) | RB040 | 0.03 | S | n/a | n/a | | |
| | RB123 | 0.03 | S | n/a | n/a | | |
| | RB403 | 0.06 | S | n/a | n/a | | |
| | RB592 | 0.25 | S | n/a | n/a | | |
| | RB415 | 0.5 | S | n/a | n/a | | |
| | RB401 | 16 | R | n/a | n/a | | |
| | RB578 | 64 | R | n/a | n/a | | |
| | RB013 | 128 | R | n/a | n/a | | |
| | RB402 | 128 | R | n/a | n/a | | |
| KpCip_ phase2 | Species: | *K. pneumoniae* | | | | | |
| | Drug: | ciprofloxacin | | | | | |
| | Concentration treated: | 1 mg/L | | | | | |
| | CLSI breakpoints (2018 M100) | | | GoPhAST-R class | | | |
| | S≤ | 1 | mg/L | S | | | |
| | I= | 2 | mg/L | R | | | |
| | R≥ | 4 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 5 | 1 | 0 | | |
| | | NS (I or R) | 0 | 0 | 6 | | |
| PHASE 2 | | Broth microdilution | | GoPhAST-R | | | |
| STATUS: | Strain | MIC | class | probR | class | agreement | |
| Strains used for phase 2 testing (classifier validation) | RB040 | 0.03 | S | 0.084 | S | concordant | S_concordant |
| | RB041 | 0.03 | S | 0.048 | S | concordant | S_concordant |
| | RB572 | 0.03 | S | 0.112 | S | concordant | S_concordant |
| | RB564 | 0.03 | S | 0.292 | S | concordant | S_concordant |
| | RB568 | 0.06 | S | 0.236 | S | concordant | S_concordant |
| | RB780 | 0.06 | S | 0.452 | S | concordant | S_concordant |
| | AR0160 | 0.06 | S | 0.366 | S | concordant | S_concordant |
| | RB274 | 0.125 | S | 0.164 | S | concordant | S_concordant |
| | RB277 | 0.125 | S | 0.216 | S | concordant | S_concordant |
| | RB565 | 0.125 | S | 0.11 | S | concordant | S_concordant |
| | RB571 | 0.125 | S | 0.428 | S | concordant | S_concordant |
| | AR0126 | 0.125 | S | 0.73 | R | discordant | S_discordant |
| | AR0034 | 1 | S | 0.58 | R | discordant | S_discordant |
| | RB419 | 16 | R | 0.866 | R | concordant | R_concordant |
| | RB583 | 16 | R | 0.784 | R | concordant | R_concordant |
| | RB287 | 64 | R | 0.994 | R | concordant | R_concordant |
| | RB290 | 64 | R | 0.998 | R | concordant | R_concordant |
| | RB543 | 64 | R | 0.848 | R | concordant | R_concordant |
| | RB563 | 64 | R | 0.994 | R | concordant | R_concordant |
| | RB569 | 64 | R | 0.872 | R | concordant | R_concordant |
| | RB579 | 64 | R | 0.88 | R | concordant | R_concordant |
| | RB582 | 64 | R | 0.98 | R | concordant | R_concordant |
| | RB013 | 128 | R | 0.994 | R | concordant | R_concordant |
| | RB039 | 128 | R | 0.996 | R | concordant | R_concordant |
| | RB408 | 128 | R | 0.998 | R | concordant | R_concordant |
| Strains used for phase 2 training (feature selection and classifier derivation) | RB041 | 0.03 | S | n/a | n/a | | |
| | RB416 | 0.03 | S | n/a | n/a | | |
| | RB040 | 0.03 | S | n/a | n/a | | |
| | RB123 | 0.03 | S | n/a | n/a | | |
| | RB403 | 0.06 | S | n/a | n/a | | |
| | RB268 | 0.125 | S | n/a | n/a | | |
| | RB592 | 0.25 | S | n/a | n/a | | |
| | RB405 | 0.5 | S | n/a | n/a | | |
| | RB415 | 0.5 | S | n/a | n/a | | |
| | RB418 | 1 | S | n/a | n/a | | |
| | RB122 | 2 | I | n/a | n/a | | |
| | RB401 | 16 | R | n/a | n/a | | |
| | RB400 | 32 | R | n/a | n/a | | |
| | RB595 | 64 | R | n/a | n/a | | |
| | RB578 | 64 | R | n/a | n/a | | |
| | RB039 | 128 | R | n/a | n/a | | |
| | RB013 | 128 | R | n/a | n/a | | |
| | RB402 | 128 | R | n/a | n/a | | |

TABLE 10-continued every strain, MIC, CLSI class, and GoPhAST-R call, sorted by MIC. For phase 1, separate train and test.

| | | | | | | | |
|---|---|---|---|---|---|---|---|
| KpGent_ phase1 | Species: | *K. pneumoniae* | | | | | |
| | Drug: | gentamicin | | | | | |
| | Concentration treated: | 4 mg/L | | | | | |
| | CLSI breakpoints (2018 M100) | | | GoPhAST-R class | | | |
| | S≤ | 4 | mg/L | S | | | |
| | I= | 8 | mg/L | R | | | |
| | R≥ | 16 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 5 | 1 | 0 | | |
| | | NS (I or R) | 0 | 0 | 4 | | |
| PHASE 1 | | Broth microdilution | | GoPhAST-R | | | |
| STATUS: | Strain | MIC | class | probR | class | agreement | |
| Strains used for phase 1 testing (classifier validation) | IDR1600039511-01-00 | 0.5 | S | 0.004 | S | concordant | |
| | UCI_7 | 0.5 | S | 0.016 | S | concordant | |
| | AR0080 | 1 | S | 0.084 | S | concordant | |
| | MGH_30 | 1 | S | 0.064 | S | concordant | |
| | RB042 | 2 | S | 0.362 | S | concordant | |
| | BIT-10 | 4 | S | 0.952 | R | discordant | 1-dilution error (S called R, i.e. not-S) |
| | UCI_63 | 4 | S | 0.948 | R | discordant | 1-dilution error (S called R, i.e. not-S) |
| | UCI_37 | 16 | R | 0.916 | R | concordant | R_concordant |
| | AR0042 | 32 | R | 0.728 | R | concordant | R_concordant |
| | BIDMC_34 | 32 | R | 0.94 | R | concordant | R_concordant |
| | MGH_63 | 32 | R | 0.95 | R | concordant | R_concordant |
| | ATCC 700721 | 64 | R | 0.816 | R | concordant | R_concordant |
| | RB122 | 128 | R | 0.932 | R | concordant | R_concordant |
| Strains used for phase 1 training (feature selection and classifier derivation) | RB040 | 0.5 | S | n/a | n/a | | |
| | UCI_13 | 0.5 | S | n/a | n/a | | |
| | BAC0800007138 | 0.5 | S | n/a | n/a | | |
| | RB121 | 1 | S | n/a | n/a | | |
| | AR0043 | 1 | S | n/a | n/a | | |
| | BWH_15 | 4 | S | n/a | n/a | | |
| | BIDMC_2A | 4 | S | n/a | n/a | | |
| | UCI_67 | 8 | I | n/a | n/a | | "I" called "R" for training |
| | RB012 | 32 | R | n/a | n/a | | |
| | AR0076 | 32 | R | n/a | n/a | | |
| | MGH_35 | 32 | R | n/a | n/a | | |
| | RB826 | 64 | R | n/a | n/a | | |
| | IDR1600031102-01-00 | 64 | R | n/a | n/a | | |
| EcMero_phase1 | Species: | *E. coli* | | | | | |
| | Drug: | meropenem | | | | | |
| | Concentration treated: | 2 mg/L | | | | | |
| | CLSI breakpoints (2018 M100) | | | GoPhAST-R class | | | |
| | S≤ | 1 | mg/L | S | | | |
| | I= | 2 | mg/L | R | | | |
| | R≥ | 4 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 5 | 1 | 0 | | |
| | | NS (I or R) | 0 | 0 | 3 | | |

TABLE 10-continued every strain, MIC, CLSI class, and GoPhAST-R call, sorted by MIC. For phase 1, separate train and test.

| PHASE 1 | | Broth mircodilution | | GoPhAST-R | | CPase/select | | |
|---|---|---|---|---|---|---|---|---|
| STATUS: | Strain | MIC | class | probR | class | ESBL | agreement | |
| Strains used for phase 1 testing (classifier validation) | AR0058 | 0.25 | S | 0.078 | S | | concordant | S_concordant |
| | BAA2523* | 0.5 | S | 0.702 | R | OXA-48 | discordant | *large inoculum effect (MIC 0.5 → 32); S called R; +CPase |
| | AR0089 | 0.5 | S | 0.204 | S | | concordant | S_concordant |
| | AR0104* | 1 | S | 0.904 | R | KPC-4 | discordant | *large inoculum effect (MIC 1 → >32); S called R; +CPase |
| | IDR1300027657 | 1 | S | 0.116 | S | | concordant | S_concordant |
| | IDR1600043633 | 2 | I | 0.874 | R | CTX-M-15 | concordant | I_concordant |
| | UVI_51 | 4 | R | 0.168 | S | CTX-M-15 | discordant | R called A, 1-dilution from int'd breakpoint, 2 from susc |
| | IDR1600029769 | 8 | R | 1 | R | OXA-48 | concordant | R_concordant |
| | BAA2469 | 16 | R | 1 | R | NDM-1 | concordant | R_concordant |
| | AR0048 | 32 | R | 0.822 | R | NDM-1; CTX-M-15 | concordant | R_concordant |
| | RB767 | 64 | R | 0.91 | R | NDM | concordant | R_concordant |
| | RB765 | 64 | R | 1 | R | NDM; KPC | concordant | R_concordant |
| | * = large inoculum effect | | | | | | | |
| Strains used for phase 1 training (feature selection and classifier derivation) | RB001 | 0.25 | S | n/a | n/a | | | |
| | RB002 | 0.25 | S | n/a | n/a | | | |
| | AR0077 | 0.5 | S | n/a | n/a | | | |
| | BIDMC_77 | 0.5 | S | n/a | n/a | CTX-M-15 | | |
| | RB076 | 0.5 | S | n/a | n/a | | | |
| | IDR1600035372 | 0.5 | S | n/a | n/a | CTX-M-15 | | |
| | RB076 | 1 | S | n/a | n/a | | | |
| | MGH_57 | 4 | R | n/a | n/a | CTX-M-15 | | |
| | AR0055 | 8 | R | n/a | n/a | NDM-1 | | |
| | AR0061 | 8 | R | n/a | n/a | KPC-3 | | |
| | AR0069 | 16 | R | n/a | n/a | NDM-1 | | |
| | IDR120024571 | 64 | R | n/a | n/a | | | |
| | IDR120039757 | 64 | R | n/a | n/a | | | |

| | | | | |
|---|---|---|---|---|
| EcCip_phase1 | Species: | *E. coli* | | |
| | Drug: | ciprofloxacin | | |
| | Concentration treated: | 1 mg/L | | |
| | CLSI breakpoints (2018 M100) | | | GoPhAST-R class |
| | S≤ | 1 | mg/L | S |
| | I= | 2 | mg/L | R |
| | R≥ | 4 | mg/L | R |
| | Aggregate performance: | | | |
| | Confusion matrix | | | |

| | | Reference (MIC by CLSI) | | |
|---|---|---|---|---|
| | SPD | S | I | R |
| Prediction | S | 5 | 1 | 0 |
| | NS (I or R) | 0 | 0 | 0 |

| PHASE 1 | | Broth microdilution | | GoPhAST-R | | | |
|---|---|---|---|---|---|---|---|
| STATUS: | Strain | MIC | class | probR | class | agreement | |
| Strains used for phase 1 testing (classifier validation) | RB001 | 0.03 | S | 0.002 | S | concordant | S_concordant |
| | RB025 | 0.25 | S | 0.156 | S | concordant | S_concordant |
| | AR0089 | 0.25 | S | 0.088 | S | concordant | S_concordant |
| | IDR1200024571 | 0.5 | S | 0.034 | S | concordant | S_concordant |
| | RB110 | 8 | R | 1 | R | concordant | R_concordant |
| | AR0085 | 16 | R | 0.972 | R | concordant | R_concordant |
| | RB086 | 64 | R | 1 | R | concordant | R_concordant |
| | BAA2469 | 64 | R | 0.9 | R | concordant | R_concordant |
| | BAC0800005647 | 64 | R | 1 | R | concordant | R_concordant |

TABLE 10-continued

| every strain, MIC, CLSI class, and GoPhAST-R call, sorted by MIC. For phase 1, separate train and test. | | | | | | | |
|---|---|---|---|---|---|---|---|
| Strains used for phase 1 training (feature selection and classifier derivation) | RB075 | 0.03 | S | n/a | n/a | | |
| | IDR1300034680 | 0.03 | S | n/a | n/a | | |
| | AR0061 | 0.25 | S | n/a | n/a | | |
| | BAA2523 | 0.5 | S | n/a | n/a | | |
| | RB077 | 1 | S | n/a | n/a | | |
| | AR0081 | 16 | R | n/a | n/a | | |
| | AR0104 | 32 | R | n/a | n/a | | |
| | RB051 | 64 | R | n/a | n/a | | |
| | RB057 | 64 | R | n/a | n/a | | |
| EcGent_phase1 | Species: | *E. coli* | | | | | |
| | Drug: | gentamicin | | | | | |
| | Concentration treated: | 4 mg/L | | | | | |
| | CLSI breakpoints (2018 M100) | | | GoPhAST-R class | | | |
| | S≤ | 4 | mg/L | S | | | |
| | I= | 8 | mg/L | R | | | |
| | R≥ | 16 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 5 | 1 | 0 | | |
| | | NS (I or R) | 0 | 0 | 0 | | |
| PHASE 1 | | Broth microdilution | | GoPhAST-R | | | |
| STATUS: | Strain | MIC | class | probR | class | agreement | |
| Strains used for phase 1 testing (classifier validation) | RB075 | 0.5 | S | 0.106 | S | concordant | S_concordant |
| | MGH_57 | 0.5 | S | 0.474 | S | concordant | S_concordant |
| | IDR1300034680 | 1 | S | 0.002 | S | concordant | S_concordant |
| | BAC0800005647 | 1 | S | 0 | S | concordant | S_concordant |
| | AR0061 | 32 | R | 1 | R | concordant | R_concordant |
| | AR0055 | 64 | R | 1 | R | concordant | R_concordant |
| | IDR1600047120 | 64 | R | 0.928 | R | concordant | R_concordant |
| | RB051 | 256 | R | 0.916 | R | concordant | R_concordant |
| Strains used for phase 1 training (feature selection and classifier derivation) | AR0081 | 0.5 | S | n/a | n/a | | |
| | AR0084 | 0.5 | S | n/a | n/a | | |
| | RB001 | 1 | S | n/a | n/a | | |
| | RB076 | 1 | S | n/a | n/a | | |
| | AR0085 | 2 | S | n/a | n/a | | |
| | BAA2469 | 64 | R | n/a | n/a | | |
| | IDR1300027657 | 64 | R | n/a | n/a | | |
| | RB765 | 64 | R | n/a | n/a | | |
| | RB057 | 256 | R | n/a | n/a | | |
| AbMero_phase1 | Species: | *A. baumanii* | | | | | |
| | Drug: | meropenem | | | | | |
| | Concentration treated: | 2 mg/L | | | | | |
| | CLSI breakpoints (2018 M100) | | | | | | |
| | S≤ | 2 | mg/L | | | | |
| | I= | 4-8 | mg/L | | | | |
| | R≥ | 16 | mg/L | | | | |
| | Aggregate performance: | | | | | | |
| | Confusion matrix | | | | | | |
| | | | Reference (MIC by CLSI) | | | | |
| | | SPD | S | I | R | | |
| | Prediction | S | 5 | 1 | 0 | | |
| | | NS (I or R) | 0 | 0 | 0 | | |

TABLE 10-continued every strain, MIC, CLSI class, and GoPhAST-R call, sorted by MIC. For phase 1, separate train and test.

| PHASE 1 | | Broth microdilution | | GoPhAST-R | | CPase/select | | |
|---|---|---|---|---|---|---|---|---|
| STATUS: | Strain | MIC | class | probR | class | ESBL | agreement | |
| Strains used for phase 1 testing (classifier validation) | RB197 | 0.5 | S | 0.042 | S | | concordant | S_concordant |
| | RB197s | 0.5 | S | 0.19 | S | | concordant | S_concordant |
| | RB206 | 1 | S | 0.6 | R | | discordant | S misclassified as R, 1 dilution from breakpoint, 2-dilution error |
| | AR0063 | 4 | I | 0.702 | R | | concordant | R_concordant |
| | RB204 | 16 | R | 0.754 | R | | concordant | R_concordant |
| | AR0036 | 16 | R | 0.668 | R | | concordant | R_concordant |
| | AR0045 | 32 | R | 0.948 | R | | concordant | R_concordant |
| | AR0101 | 64 | R | 0.882 | R | | concordant | R_concordant |
| | RB203 | 64 | R | 0.998 | R | | concordant | R_concordant |
| | AR0078 | 64 | R | 0.88 | R | | concordant | R_concordant |
| | AR0035 | 64 | R | 0.834 | R | | concordant | R_concordant |
| Strains used for phase 1 training (feature selection and classifier derivation) | RB201 | 0.25 | S | n/a | n/a | | | |
| | ATCC 17978 | 0.5 | S | n/a | n/a | | | |
| | RB205 | 1 | S | n/a | n/a | | | |
| | AR0052 | 2 | S | n/a | n/a | | | |
| | AR0102 | 4 | I | n/a | n/a | | | "I" called "R" for training |
| | RB198 | 8 | I | n/a | n/a | | | "I" called "R" for training |
| | AR0070 | 16 | R | n/a | n/a | | | |
| | RB202 | 32 | R | n/a | n/a | | | |
| | RB200 | 64 | R | n/a | n/a | | | |
| | AR0033 | 64 | R | n/a | n/a | NDM-1 | | |
| | AR0037 | 64 | R | n/a | n/a | NDM-1 | | |
| | AR0056 | 64 | R | n/a | n/a | | | |
| | NOTE: "s" modifier to strain name denotes small colony morphotype of RB197 | | | | | | | |

| | | | |
|---|---|---|---|
| AbCip_phase1 | Species: | *A. baumanii* | |
| | Drug: | ciprofloxacin | |
| | Concentration treated: | 1 mg/L | |
| | CLSI breakpoints (2018 M100) | | |
| | S≤ | 1 | mg/L |
| | I= | 2 | mg/L |
| | R≥ | 4 | mg/L |
| | Aggregate performance: | | |
| | Confusion matrix | | |

| | | Reference (MIC by CLSI) | | |
|---|---|---|---|---|
| | SPD | S | I | R |
| Prediction | S | 5 | 1 | 0 |
| | NS (I or R) | 0 | 0 | 3 |

| PHASE 1 | | Broth microdilution | | GoPhAST-R | | | |
|---|---|---|---|---|---|---|---|
| STATUS: | Strain | MIC | class | probR | class | agreement | |
| Strains used for phase 1 testing (classifier validation) | RB201 | 0.25 | S | 0.308 | S | concordant | S_concordant |
| | RB201a | 0.25 | S | 0.136 | S | concordant | S_concordant |
| | RB197s | 0.25 | S | 0.114 | S | concordant | S_concordant |
| | RB205 | 1 | S | 0.012 | S | concordant | S_concordant |
| | AR0063 | 8 | R | 1 | R | concordant | R_concordant |
| | RB198 | 64 | R | 0.942 | R | concordant | R_concordant |
| | RB203 | 64 | R | 1 | R | concordant | R_concordant |
| | RB206 | 64 | R | 1 | R | concordant | R_concordant |
| | AR0035 | 64 | R | 1 | R | concordant | R_concordant |
| | AR0045 | 64 | R | 1 | R | concordant | R_concordant |
| | AR0078 | 64 | R | 1 | R | concordant | R_concordant |
| | AR0102 | 64 | R | 1 | R | concordant | R_concordant |

TABLE 10-continued

| every strain, MIC, CLSI class, and GoPhAST-R call, sorted by MIC. For phase 1, separate train and test. | | | | | | |
|---|---|---|---|---|---|---|
| Strains used for phase 1 training (feature selection and classifier derivation) | RB197 | 0.25 | S | n/a | n/a | |
| | RB197b | 0.25 | S | n/a | n/a | |
| | RB197a | 0.25 | S | n/a | n/a | |
| | ATCC 17978 | 0.5 | S | n/a | n/a | |
| | AR0052 | 4 | R | n/a | n/a | |
| | AR0070 | 8 | R | n/a | n/a | |
| | RB202 | 64 | R | n/a | n/a | |
| | RB204 | 64 | R | n/a | n/a | |
| | AR0033 | 64 | R | n/a | n/a | |
| | AR0037 | 64 | R | n/a | n/a | |
| | AR0056 | 64 | R | n/a | n/a | |
| | AR0101 | 64 | R | n/a | n/a | |
| | AR0036 | 64 | R | n/a | n/a | |
| | NOTE: "a", "b", and "c" modifier to strain names denote biological replicates: separate colonies of each isolate, grown and treated separately (done because of paucity of cip-S *A. baumanii* strains in the collection) | | | | | |
| AbGent_phase1 | Species: | *A. baumanii* | | | | |
| | Drug: | gentamicin | | | | |
| | Concentration treated: | 4 mg/L | | | | |
| | CLSI breakpoints (2018 M100) | | | | | |
| | S≤ | 4 | mg/L | | | |
| | I= | 8 | mg/L | | | |
| | R≥ | 16 | mg/L | | | |
| | Aggregate performance: | | | | | |
| | Confusion matrix | | | | | |
| | | | Reference (MIC by CLSI) | | | |
| | | SPD | S | I | R | |
| | Prediction | S | 5 | 1 | 0 | |
| | | NS (I or R) | 0 | 0 | 1 | |
| PHASE 1 | | Broth microdilution | | GoPhAST-R | | |
| STATUS: | Strain | MIC | class | probR | class | agreement |
| Strains used for phase 1 testing (classifier validation) | ATCC 17978 | 0.5 | S | 0.162 | S | concordant |
| | RB205 | 2 | S | 0.248 | S | concordant |
| | AR0063 | 4 | S | 0.088 | S | concordant |
| | AR0035 | 16 | R | 0.958 | R | concordant |
| | AR0052 | 32 | R | 1 | R | concordant |
| | RB200 | 64 | R | 1 | R | concordant |
| | RB204 | 64 | R | 0.958 | R | concordant |
| | AR0037 | 64 | R | 1 | R | concordant |
| | AR0056 | 64 | R | 1 | R | concordant |
| | AR0078 | 64 | R | 1 | R | concordant |
| Strains used for phase 1 training (feature selection and classifier derivation) | RB197 | 0.5 | S | n/a | n/a | |
| | RB201 | 1 | S | n/a | n/a | |
| | RB203 | 4 | S | n/a | n/a | |
| | AR0101 | 8 | I | n/a | n/a | "I" called "R" for training |
| | AR0033 | 32 | R | n/a | n/a | |
| | RB198 | 64 | R | n/a | n/a | |
| | RB202 | 64 | R | n/a | n/a | |
| | RB206 | 64 | R | n/a | n/a | |
| | AR0045 | 64 | R | n/a | n/a | |
| | AR0070 | 64 | R | n/a | n/a | |
| | AR0102 | 64 | R | n/a | n/a | |
| PaCip_phase1 | Species: | *P. aeruginosa* | | | | |
| | Drug: | ciprofloxacin | | | | |
| | Concentration treated: | 1 mg/L | | | | |
| | CLSI breakpoints (2018 M100) | | | GoPhAST-R class | | |
| | S≤ | 0.5 | mg/L | S | | |
| | I= | 1 | mg/L | R | | |

TABLE 10-continued every strain, MIC, CLSI class, and GoPhAST-R call, sorted by MIC. For phase 1, separate train and test.

| | | | | | | | |
|---|---|---|---|---|---|---|---|
| | R≥ | 2 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 6 | 0 | 0 | | |
| | | NS (I or R) | 0 | 1 | 5 | | |
| PHASE 1 | | Broth microdilution | | GoPhAST-R | | | |
| STATUS: | Strain | MIC | class | probR | class | agreement | |
| Strains used for phase 1 testing (classifier validation) | BL08 | 0.06 | S | 0.242 | S | concordant | |
| | BWHPSA043 | 0.06 | S | 0.024 | S | concordant | |
| | CF18 | 0.06 | S | 0.198 | S | concordant | |
| | BL11 | 0.125 | S | 0.394 | S | concordant | |
| | UDL | 0.125 | S | 0.332 | S | concordant | |
| | BL22 | 0.5 | S | 0.498 | S | concordant | |
| | CF27 | 1 | I | 0.86 | R | concordant | |
| | BWHPSA048 | 8 | R | 0.678 | R | concordant | |
| | X13273 | 8 | R | 0.896 | R | concordant | |
| | BL17 | 16 | R | 0.994 | R | concordant | |
| | BWHPSA006 | 16 | R | 1 | R | concordant | |
| | BWH053 | 16 | R | 1 | R | concordant | |
| Strains used for phase 1 training (feature selection and classifier derivation) | BWH029 | 0.03 | S | n/a | n/a | | |
| | BWH033 | 0.06 | S | n/a | n/a | | |
| | BWHPSA046 | 0.06 | S | n/a | n/a | | |
| | BL01 | 0.125 | S | n/a | n/a | | "I" called "R" for training |
| | BWH055 | 0.125 | S | n/a | n/a | | |
| | BWH050 | 0.25 | S | n/a | n/a | | |
| | BWHPSA041 | 2 | R | n/a | n/a | | |
| | CF5 | 8 | R | n/a | n/a | | |
| | BL03 | 16 | R | n/a | n/a | | |
| | BWHPSA003 | 16 | R | n/a | n/a | | |
| | BWH049 | 16 | R | n/a | n/a | | |
| | X24509 | 64 | R | n/a | n/a | | |

| | | | | | | | |
|---|---|---|---|---|---|---|---|
| Sa_Levo_phase1 | Species: | *S. aureus* | | | | | |
| | Drug: | levofloxacin | | | | | |
| | Concentration treated: | 1 mg/L | | | | | |
| | CLSI breakpoints (2018 M100) | | | GoPhAST-R class | | | |
| | S≤ | 1 | mg/L | S | | | |
| | I= | 2 | mg/L | R | | | |
| | Aggregate performance: | | | | | | |
| | Confusion matrix | | | | | | |
| | | | Reference (MIC by CLSI) | | | | |
| | | SPD | S | I | R | | |
| | Prediction | S | 6 | 0 | 0 | | |
| | | NS (I or R) | 0 | 0 | 6 | | |
| PHASE 1 | | Broth microdilution | | GoPhAST-R | | | |
| STATUS: | Strain | MIC | class | probR | class | agreement | Comments |
| Strains used for phase 1 testing (classifier validation) | RB065 | 0.06 | S | 0.002 | S | concordant | |
| | RB067 | 0.13 | S | 0.012 | S | concordant | |
| | RB069 | 0.13 | S | 0 | S | concordant | |
| | RB098 | 0.13 | S | 0 | S | concordant | |
| | RB223 | 0.13 | S | 0.002 | S | concordant | |
| | RB247 | 0.5 | S | 0.006 | S | concordant | |
| | RB064 | 8 | R | 1 | R | concordant | |
| | RB211 | 16 | R | 1 | R | concordant | |
| | RB045 | 32 | R | 1 | R | concordant | |
| | RB090 | 32 | R | 1 | R | concordant | |
| | RB219 | 32 | R | 1 | R | concordant | |
| | RB047 | 64 | R | 1 | R | concordant | |

TABLE 10-continued

| every strain, MIC, CLSI class, and GoPhAST-R call, sorted by MIC. For phase 1, separate train and test. | | | | | |
|---|---|---|---|---|---|
| Strains used for phase 1 training (feature selection and classifier derivation) | RB006 | 0.06 | S | n/a | n/a |
| | RB066 | 0.06 | S | n/a | n/a |
| | RB003 | 0.125 | S | n/a | n/a |
| | RB096 | 0.13 | S | n/a | n/a |
| | RB221 | 0.13 | S | n/a | n/a |
| | RB245 | 0.25 | S | n/a | n/a |
| | RB072 | 4 | R | n/a | n/a |
| | RB007 | 16 | R | n/a | n/a |
| | RB004 | 32 | R | n/a | n/a |
| | RB074 | 32 | R | n/a | n/a |
| | RB095 | 32 | R | n/a | n/a |
| | RB010 | 64 | R | n/a | n/a |

One skilled in the art would readily appreciate that the present disclosure is well adapted to carry out the objects and obtain the ends and advantages mentioned, as well as those inherent therein. The methods and compositions described herein as presently representative of preferred embodiments are exemplary and are not intended as limitations on the scope of the disclosure. Changes therein and other uses will occur to those skilled in the art, which are encompassed within the spirit of the disclosure, are defined by the scope of the claims.

In addition, where features or aspects of the disclosure are described in terms of Markush groups or other grouping of alternatives, those skilled in the art will recognize that the disclosure is also thereby described in terms of any individual member or subgroup of members of the Markush group or other group.

The use of the terms “a” and “an” and “the” and similar referents in the context of describing the disclosure (especially in the context of the following claims) are to be construed to cover both the singular and the plural, unless otherwise indicated herein or clearly contradicted by context. The terms “comprising,” “having,” “including,” and “containing” are to be construed as open-ended terms (i.e., meaning “including, but not limited to,”) unless otherwise noted. Recitation of ranges of values herein are merely intended to serve as a shorthand method of referring individually to each separate value falling within the range, unless otherwise indicated herein, and each separate value is incorporated into the specification as if it were individually recited herein.

All methods described herein can be performed in any suitable order unless otherwise indicated herein or otherwise clearly contradicted by context. The use of any and all examples, or exemplary language (e.g., “such as”) provided herein, is intended merely to better illuminate the disclosure and does not pose a limitation on the scope of the disclosure unless otherwise claimed. No language in the specification should be construed as indicating any non-claimed element as essential to the practice of the disclosure.

Embodiments of this disclosure are described herein, including the best mode known to the inventors for carrying out the disclosed disclosure. Variations of those embodiments may become apparent to those of ordinary skill in the art upon reading the foregoing description.

The disclosure illustratively described herein suitably can be practiced in the absence of any element or elements, limitation or limitations that are not specifically disclosed herein. Thus, for example, in each instance herein any of the terms “comprising”, “consisting essentially of”, and “consisting of” may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the disclosure claimed. Thus, it should be understood that although the present disclosure provides preferred embodiments, optional features, modification and variation of the concepts herein disclosed may be resorted to by those skilled in the art, and that such modifications and variations are considered to be within the scope of this disclosure as defined by the description and the appended claims.

It will be readily apparent to one skilled in the art that varying substitutions and modifications can be made to the disclosure disclosed herein without departing from the scope and spirit of the disclosure. Thus, such additional embodiments are within the scope of the present disclosure and the following claims. The inventors expect skilled artisans to employ such variations as appropriate, and the inventors intend for the disclosure to be practiced otherwise than as specifically described herein. Accordingly, this disclosure includes all modifications and equivalents of the subject matter recited in the claims appended hereto as permitted by applicable law. Moreover, any combination of the above-described elements in all possible variations thereof is encompassed by the disclosure unless otherwise indicated herein or otherwise clearly contradicted by context. Those skilled in the art will recognize, or be able to ascertain using no more than routine experimentation, many equivalents to the specific embodiments of the disclosure described herein. Such equivalents are intended to be encompassed by the following claims.

REFERENCES

Abeel, T., T. Van Parys, Y. Saeys, J. Galagan, and Y. Van de Peer. 2012. ‘GenomeView: a next-generation genome browser’, Nucleic Acids Res, 40: e12.

Adams-Sapper, S., S. Nolen, G. F. Donzelli, M. Lal, K. Chen, L. H. Justo da Silva, B. M. Moreira, and L. W. Riley. 2015. ‘Rapid induction of high-level carbapenem resistance in heteroresistant KPC-producing *Klebsiella pneumoniae*’, Antimicrob Agents Chemother, 59:3281-9.

Adler, A., M. Ben-Dalak, I. Chmelnitsky, and Y. Carmeli. 2015. ‘Effect of Resistance Mechanisms on the Inoculum Effect of Carbapenem in *Klebsiella pneumoniae* Isolates with Borderline Carbapenem Resistance’, Antimicrob Agents Chemother, 59:5014-7.

Allcock, R. J. N., A. V. Jennison, and D. Warrilow. 2017. ‘Towards a Universal Molecular Microbiological Test’, J Clin Microbiol, 55:3175-82.

Anderson, K. F., D. R. Lonsway, J. K. Rasheed, J. Biddle, B. Jensen, L. K. McDougal, R. B. Carey, A. Thompson, S. Stocker, B. Limbago, and J. B. Patel. 2007. 'Evaluation of methods to identify the *Klebsiella pneumoniae* carbapenemase in Enterobacteriaceae', J Clin Microbiol, 45:2723-5.

Arnold, R. S., K. A. Thom, S. Sharma, M. Phillips, J. Kristie Johnson, and D. J. Morgan. 2011. 'Emergence of *Klebsiella pneumoniae* carbapenemase-producing bacteria', South Med J, 104:40-5.

Arzanlou, M., Chai, W. C. & Venter, H. Intrinsic, adaptive and acquired antimicrobial resistance in Gram-negative bacteria. Essays Biochem 61, 49-59, doi: 10.1042/EBC20160063 (2017).

Barczak, A. K., J. E. Gomez, B. B. Kaufmann, E. R. Hinson, L. Cosimi, M. L. Borowsky, A. B. Onderdonk, S. A. Stanley, D. Kaur, K. F. Bryant, D. M. Knipe, A. Sloutsky, and D. T. Hung. 2012. 'RNA signatures allow rapid identification of pathogens and antibiotic susceptibilities', Proc Natl Acad Sci USA, 109: 6217-22.

Bhattacharyya, R. P., M. Walker, R. Boykin, S. S. Son, J. Liu, A. C. Hachey, P. Ma, L. Wu, K. Choi, K. C. Cummins, M. Benson, J. Skerry, H. Ryu, S. Y. Wong, M. B. Goldberg, J. Han, V. M. Pierce, L. A. Cosimi, N. Shoresh, J. Livny, J. Beechem, and D. T. Hung. 2019. 'Rapid identification and phylogenetic classification of diverse bacterial pathogens in a multiplexed hybridization assay targeting ribosomal RNA', Sci Rep.

Bhattacharyya, R. P., Grad, Y. H. & Hung, D. T. in Harrison's Principles of Internal Medicine (eds J. L. Jameson et al.) Ch. 474, 3491-3504 (McGraw-Hill Education, 2018).

Boehme, C. C. et al. Rapid molecular detection of tuberculosis and rifampin resistance. N Engl J Med 363, 1005-1015, doi: 10.1056/NEJMoa0907847 (2010). Bradley, P., H. C. den Bakker, E. P. C. Rocha, G. Mc Vean, and Z. Iqbal. 2019. 'Ultrafast search of all deposited bacterial and viral genomic data', Nat Biotechnol, 37:152-59.

Bradley, P., N. C. Gordon, T. M. Walker, L. Dunn, S. Heys, B. Huang, S. Earle, L. J. Pankhurst, L. Anson, M. de Cesare, P. Piazza, A. A. Votintseva, T. Golubchik, D. J. Wilson, D. H. Wyllie, R. Diel, S. Niemann, S. Feuerriegel, T. A. Kohl, N. Ismail, S. V. Omar, E. G. Smith, D. Buck, G. McVean, A. S. Walker, T. E. Peto, D. W. Crook, and Z. Iqbal. 2015. 'Rapid antibiotic-resistance predictions from genome sequence data for *Staphylococcus aureus* and *Mycobacterium tuberculosis*', Nat Commun, 6:10063.

Bradley, P., den Bakker, H. C., Rocha, E. P. C., McVean, G. & Iqbal, Z. Ultrafast search of all deposited bacterial and viral genomic data. Nat Biotechnol 37, 152-159, doi: 10.1038/s41587-018-0010-1 (2019).

Brown, L. D., Cai, T. T. & DasGupta, A. Interval Estimation for a Binomial Proportion. Statist Sci 16, 101-133, doi: 10.1214/ss/1009213286 (2001).

Burnham, C. D., Leeds, J., Nordmann, P., O'Grady, J. & Patel, J. Diagnosing antimicrobial resistance. Nat Rev Microbiol 15, 697-703, doi: 10.1038/nrmicro.2017.103 (2017).

Caniaux, I., A. van Belkum, G. Zambardi, L. Poirel, and M. F. Gros. 2017. 'MCR: modern colistin resistance', Eur J Clin Microbiol Infect Dis, 36:415-20.

Canton, R., Gonzalez-Alba, J. M. & Galan, J. C. CTX-M Enzymes: Origin and Diffusion. Front Microbiol 3, 110, doi: 10.3389/fmicb.2012.00110 (2012).

Centers for Disease, Control, and Prevention. 2009. 'Guidance for control of infections with carbapenem-resistant or carbapenemase-producing Enterobacteriaceae in acute care facilities', MMWR Morb Mortal Wkly Rep, 58:256-60.

Cermak, N., S. Olcum, F. F. Delgado, S. C. Wasserman, K. R. Payer, A. Murakami M, S. M. Knudsen, R. J. Kimmerling, M. M. Stevens, Y. Kikuchi, A. Sandikci, M. Ogawa, V. Agache, F. Baleras, D. M. Weinstock, and S. R. Manalis. 2016. 'High-throughput measurement of single-cell growth rates using serial microfluidic mass sensor arrays', Nat Biotechnol, 34:1052-59.

Cerqueira, G. C., A. M. Earl, C. M. Ernst, Y. H. Grad, J. P. Dekker, M. Feldgarden, S. B. Chapman, J. L. Reis-Cunha, T. P. Shea, S. Young, Q. Zeng, M. L. Delaney, D. Kim, E. M. Peterson, T. F. O'Brien, M. J. Ferraro, D. C. Hooper, S. S. Huang, J. E. Kirby, A. B. Onderdonk, B. W. Birren, D. T. Hung, L. A. Cosimi, J. R. Wortman, C. I. Murphy, and W. P. Hanage. 2017. 'Multi-institute analysis of carbapenem resistance reveals remarkable diversity, unexplained mechanisms, and limited clonal outbreaks', Proc Natl Acad Sci USA, 114:1135-40.

Charnot-Katsikas, A., V. Tesic, N. Love, B. Hill, C. Bethel, S. Boonlayangoor, and K. G. Beavis. 2018. 'Use of the Accelerate Pheno System for Identification and Antimicrobial Susceptibility Testing of Pathogens in Positive Blood Cultures and Impact on Time to Results and Workflow', J Clin Microbiol, 56.

Chea, N., S. N. Bulens, T. Kongphet-Tran, R. Lynfield, K. M. Shaw, P. S. Vagnone, M. A. Kainer, D. B. Muleta, L. Wilson, E. Vaeth, G. Dumyati, C. Concannon, E. C. Phipps, K. Culbreath, S. J. Janelle, W. M. Bamberg, A. Y. Guh, B. Limbago, and A. J. Kallen. 2015. 'Improved Phenotype-Based Definition for Identifying Carbapenemase Producers among Carbapenem-Resistant Enterobacteriaceae', Emerg Infect Dis, 21:1611-6.

Choi, J., H. Y. Jeong, G. Y. Lee, S. Han, S. Han, B. Jin, T. Lim, S. Kim, D. Y. Kim, H. C. Kim, E. C. Kim, S. H. Song, T. S. Kim, and S. Kwon. 2017. 'Direct, rapid antimicrobial susceptibility test from positive blood cultures based on microscopic imaging analysis', Sci Rep, 7:1148.

Clark, R. B., Lewinski, M. A., Loeffelholz, M. J. & Tibbetts, R. J. Cumitech 31A, Verification and validation of procedures in the clinical microbiology laboratory. (ASM Press, 2009).

CLSI. Methods for Dilution Antimicrobial Susceptibility Tests for Bacteria That Grow Aerobically. 11th edn. CLSI Supplement M07. Wayne, PA: Clinical and Laboratory Standards Institute (2018). CLSI. 2018. Performance Standards for Antimicrobial Susceptibility Testing.

Consortium, C. RyPTIC, Genomes Project the, C. Allix-Beguec, I. Arandjelovic, L. Bi, P. Beckert, M. Bonnet, P. Bradley, A. M. Cabibbe, I. Cancino-Munoz, M. J. Caulfield, A. Chaiprasert, D. M. Cirillo, D. A. Clifton, I. Comas, D. W. Crook, M. R. De Filippo, H. de Neeling, R. Diel, F. A. Drobniewski, K. Faksri, M. R. Farhat, J. Fleming, P. Fowler, T. A. Fowler, Q. Gao, J. Gardy, D. Gascoyne-Binzi, A. L. Gibertoni-Cruz, A. Gil-Brusola, T. Golubchik, X. Gonzalo, L. Grandjean, G. He, J. L. Guthrie, S. Hoosdally, M. Hunt, Z. Iqbal, N. Ismail, J. Johnston, F. M. Khanzada, C. C. Khor, T. A. Kohl, C. Kong, S. Lipworth, Q. Liu, G. Maphalala, E. Martinez, V. Mathys, M. Merker, P. Miotto, N. Mistry, D. A. J. Moore, M. Murray, S. Niemann, S. V. Omar, R. T. Ong, T. E. A. Peto, J. E. Posey, T. Prammananan, A. Pym, C. Rodrigues, M. Rodrigues, T. Rodwell, G. M. Rossolini, E. Sanchez Padilla, M. Schito, X. Shen, J. Shendure, V. Sintchenko, A. Sloutsky, E. G. Smith, M. Snyder, K. Soetaert, A. M.

Starks, P. Supply, P. Suriyapol, S. Tahseen, P. Tang, Y. Y. Teo, T. N. T. Thuong, G. Thwaites, E. Tortoli, D. van Soolingen, A. S. Walker, T. M. Walker, M. Wilcox, D. J. Wilson, D. Wyllie, Y. Yang, H. Zhang, Y. Zhao, and B. Zhu. 2018. 'Prediction of Susceptibility to First-Line Tuberculosis Drugs by DNA Sequencing', N Engl J Med, 379:1403-15.

Cubero, M. et al. Carbapenem-resistant and carbapenem-susceptible isogenic isolates of *Klebsiella pneumoniae* ST101 causing infection in a tertiary hospital. BMC Microbiol 15, 177, doi: 10.1186/s12866-015-0510-9 (2015).

Didelot, X., R. Bowden, D. J. Wilson, T. E. A. Peto, and D. W. Crook. 2012. 'Transforming clinical microbiology with bacterial genome sequencing', Nat Rev Genet, 13:601-12.

Efron, B. & Gong, G. A Leisurely Look at the Bootstrap, the Jackknife, and Cross-Validation. American Statistician 37, 36-48, doi: Doi 10.2307/2685844 (1983).

Ellington, M. J., O. Ekelund, F. M. Aarestrup, R. Canton, M. Doumith, C. Giske, H. Grundman, H. Hasman, M. T. G. Holden, K. L. Hopkins, J. Iredell, G. Kahlmeter, C. U. Koser, A. MacGowan, D. Mevius, M. Mulvey, T. Naas, T. Peto, J. M. Rolain, O. Samuelsen, and N. Woodford. 2017. 'The role of whole genome sequencing in antimicrobial susceptibility testing of bacteria: report from the EUCAST Subcommittee', Clin Microbiol Infect, 23:2-22.

Evans, S. R., A. M. Hujer, H. Jiang, K. M. Hujer, T. Hall, C. Marzan, M. R. Jacobs, R. Sampath, D. J. Ecker, C. Manca, K. Chavda, P. Zhang, H. Fernandez, L. Chen, J. R. Mediavilla, C. B. Hill, F. Perez, A. M. Caliendo, V. G. Fowler, Jr., H. F. Chambers, B. N. Kreiswirth, R. A. Bonomo, and Group Antibacterial Resistance Leadership. 2016. 'Rapid Molecular Diagnostics, Antibiotic Treatment Decisions, and Developing Approaches to Inform Empiric Therapy: PRIMERS I and II', Clin Infect Dis, 62:181-9.

Fauci, A. S. & Morens, D. M. The perpetual challenge of infectious diseases. N Engl J Med 366, 454-461, doi: 10.1056/NEJMra1108296 (2012).

Florio, W., Tavanti, A., Barnini, S., Ghelardi, E. & Lupetti, A. Recent Advances and Ongoing Challenges in the Diagnosis of Microbial Infections by MALDI-TOF Mass Spectrometry. Front Microbiol 9, 1097, doi: 10.3389/fmich.2018.01097 (2018).

Ford, B. A. 2018. 'mecC-Harboring Methicillin-Resistant *Staphylococcus aureus*: Hiding in Plain Sight', J Clin Microbiol, 56.

Garcia-Alvarez, L., M. T. Holden, H. Lindsay, C. R. Webb, D. F. Brown, M. D. Curran, E. Walpole, K. Brooks, D. J. Pickard, C. Teale, J. Parkhill, S. D. Bentley, G. F. Edwards, E. K. Girvan, A. M. Kearns, B. Pichon, R. L. Hill, A. R. Larsen, R. L. Skov, S. J. Peacock, D. J. Maskell, and M. A. Holmes. 2011. 'Meticillin-resistant *Staphylococcus aureus* with a novel mecA homologue in human and bovine populations in the UK and Denmark: a descriptive study', Lancet Infect Dis, 11:595-603.

Geiss, G. K., R. E. Bumgarner, B. Birditt, T. Dahl, N. Dowidar, D. L. Dunaway, H. P. Fell, S. Ferree, R. D. George, T. Grogan, J. J. James, M. Maysuria, J. D. Mitton, P. *Oliveri*, J. L. Osborn, T. Peng, A. L. Ratcliffe, P. J. Webster, E. H. Davidson, L. Hood, and K. Dimitrov. 2008. 'Direct multiplexed measurement of gene expression with color-coded probe pairs', Nat Biotechnol, 26:317-25.

Gotz, S. et al. High-throughput functional annotation and data mining with the Blast2GO suite. Nucleic Acids Res 36, 3420-3435, doi: 10.1093/nar/gkn176 (2008).

Gupta, N., Limbago, B. M., Patel, J. B. & Kallen, A. J. Carbapenem-resistant Enterobacteriaceae: epidemiology and prevention. Clin Infect Dis 53, 60-67, doi: 10.1093/cid/cir202 (2011).

Gupta, S. K. et al. ARG-ANNOT, a new bioinformatic tool to discover antibiotic resistance genes in bacterial genomes. Antimicrob Agents Chemother 58, 212-220, doi: 10.1128/AAC.01310-13 (2014).

Gupta, V., R. Garg, K. Kumaraswamy, P. Datta, G. K. Mohi, and J. Chander. 2018. 'Phenotypic and genotypic characterization of carbapenem resistance mechanisms in *Klebsiella pneumoniae* from blood culture specimens: A study from North India', J Lab Physicians, 10:125-29

Holdren, J. P. et al. President's Council of Advisors on Science and Technology: Report to the President on Combating Antibiotic Resistance. (2014).

Hooper, D. C. New uses for new and old quinolones and the challenge of resistance. Clin Infect Dis 30, 243-254, doi: 10.1086/313677 (2000).

Hou, H. W., R. P. Bhattacharyya, D. T. Hung, and J. Han. 2015. 'Direct detection and drug-resistance profiling of bacteremias using inertial microfluidics', Lab Chip, 15:2297-307.

Humphries, R., and T. Di Martino. 2019. 'Effective implementation of the Accelerate Pheno system for positive blood cultures', J Antimicrob Chemother, 74:140-i43.

Humphries, R. M. CIM City: The game continues for a better carbapenemase test. J Clin Microbiol, doi: 10.1128/JCM.00353-19 (2019).

Ioannidis, P. et al. Cepheid GeneXpert MTB/RIF assay for *Mycobacterium tuberculosis* detection and rifampin resistance identification in patients with substantial clinical indications of tuberculosis and smear-negative microscopy results. J Clin Microbiol 49, 3068-3070, doi: 10.1128/JCM.00718-11 (2011).

Iovleva, A. & Doi, Y. Carbapenem-Resistant Enterobacteriaceae. Clin Lab Med 37, 303-315, doi: 10.1016/j.cll.2017.01.005 (2017).

Jia, B. et al. CARD 2017: expansion and model-centric curation of the comprehensive antibiotic resistance database. Nucleic Acids Res 45, D566-D573, doi: 10.1093/nar/gkw1004 (2017).

Kaase, M., F. Szabados, L. Wassill, and S. G. Gatermann. 2012. 'Detection of carbapenemases in Enterobacteriaceae by a commercial multiplex PCR', J Clin Microbiol, 50:3115-8.

Kadri, S. S. et al. Difficult-to-Treat Resistance in Gram-negative Bacteremia at 173 US Hospitals: Retrospective Cohort Analysis of Prevalence, Predictors, and Outcome of Resistance to All First-line Agents. Clin Infect Dis 67, 1803-1814, doi: 10.1093/cid/ciy378 (2018).

Klungthong, C., P. Chinnawirotpisan, K. Hussem, T. Phonpakobsin, W. Manasatienkij, C. Ajariyakhajorn, K. Rungrojcharoenkit, R. V. Gibbons, and R. G. Jarman. 2010. 'The impact of primer and probe-template mismatches on the sensitivity of pandemic influenza A/H1N1/2009 virus detection by real-time RT-PCR', J Clin Virol, 48:91-5.

Kumar, A., D. Roberts, K. E. Wood, B. Light, J. E. Parrillo, S. Sharma, R. Suppes, D. Feinstein, S. Zanotti, L. Taiberg, D. Gurka, A. Kumar, and M. Cheang. 2006. 'Duration of hypotension before initiation of effective antimicrobial therapy is the critical determinant of survival in human septic shock', Crit Care Med, 34:1589-96.

Letunic, I. & Bork, P. Interactive Tree Of Life (iTOL) v4: recent updates and new developments. Nucleic Acids Res 47, W256-W259, doi: 10.1093/nar/gkz239 (2019).

Li, H., and R. Durbin. 2009. 'Fast and accurate short read alignment with Burrows-Wheeler transform', Bioinformatics, 25:1754-60.

Li, Y. et al. Penicillin-Binding Protein Transpeptidase Signatures for Tracking and Predicting beta-Lactam Resistance Levels in *Streptococcus pneumoniae*. MBio 7, doi: 10.1128/mBio.00756-16 (2016).

Liakopoulos, A., D. J. Mevius, B. Olsen, and J. Bonnedahl. 2016. 'The colistin resistance mcr-1 gene is going wild', J Antimicrob Chemother, 71:2335-6.

Liaw, A. & Wiener, M. Classification and Regression by RandomForest. Vol. 23 (2001).

Liu, B., and M. Pop. 2009. 'ARDB—Antibiotic Resistance Genes Database', Nucleic Acids Res, 37: D443-7.

Liu, Y. Y., Y. Wang, T. R. Walsh, L. X. Yi, R. Zhang, J. Spencer, Y. Doi, G. Tian, B. Dong, X. Huang, L. F. Yu, D. Gu, H. Ren, X. Chen, L. Lv, D. He, H. Zhou, Z. Liang, J. H. Liu, and J. Shen. 2016. 'Emergence of plasmid-mediated colistin resistance mechanism MCR-1 in animals and human beings in China: a microbiological and molecular biological study', Lancet Infect Dis, 16:161-8.

Lomovskaya, O., D. Sun, D. Rubio-Aparicio, K. Nelson, R. Tsivkovski, D. C. Griffith, and M. N. Dudley. 2017. 'Vaborbactam: Spectrum of Beta-Lactamase Inhibition and Impact of Resistance Mechanisms on Activity in Enterobacteriaceae', Antimicrob Agents Chemother, 61.

Longo, G., L. Alonso-Sarduy, L. M. Rio, A. Bizzini, A. Trampuz, J. Notz, G. Dietler, and S. Kasas. 2013. 'Rapid detection of bacterial resistance to antibiotics using AFM cantilevers as nanomechanical sensors', Nat Nanotechnol, 8:522-6.

Love, M. I., W. Huber, and S. Anders. 2014. 'Moderated estimation of fold change and dispersion for RNA-seq data with DESeq2', Genome Biol, 15:550.

Lutgring, J. D., and B. M. Limbago. 2016. 'The Problem of Carbapenemase-Producing-Carbapenem-Resistant-Enterobacteriaceae Detection', J Clin Microbiol, 54:529-34.

Ma, P., H. H. Laibinis, C. M. Ernst, and D. T. Hung. 2018. 'Carbapenem Resistance Caused by High-Level Expression of OXA-663 beta-Lactamase in an OmpK36-Deficient *Klebsiella pneumoniae* Clinical Isolate', Antimicrob Agents Chemother, 62.

Marlowe, E. M. et al. Evaluation of the Cepheid Xpert MTB/RIF assay for direct detection of *Mycobacterium tuberculosis* complex in respiratory specimens. J Clin Microbiol 49, 1621-1623, doi: 10.1128/JCM.02214-10 (2011).

Marner, E. S. et al. Diagnostic accuracy of the Cepheid GeneXpert vanA/vanB assay ver. 1.0 to detect the vanA and vanB vancomycin resistance genes in *Enterococcus* from perianal specimens. Diagn Microbiol Infect Dis 69, 382-389, doi: 10.1016/j.diagmicrobio.2010.11.005 (2011).

Marschal, M., J. Bachmaier, I. Autenrieth, P. Oberhettinger, M. Willmann, and S. Peter. 2017. 'Evaluation of the Accelerate Pheno System for Fast Identification and Antimicrobial Susceptibility Testing from Positive Blood Cultures in Bloodstream Infections Caused by Gram-Negative Pathogens', J Clin Microbiol, 55:2116-26.

Marshall, S., A. M. Hujer, L. J. Rojas, K. M. Papp-Wallace, R. M. Humphries, B. Spellberg, K. M. Hujer, E. K. Marshall, S. D. Rudin, F. Perez, B. M. Wilson, R. B. Wasserman, L. Chikowski, D. L. Paterson, A. J. Vila, D. van Duin, B. N. Kreiswirth, H. F. Chambers, V. G. Fowler, Jr., M. R. Jacobs, M. E. Pulse, W. J. Weiss, and R. A. Bonomo. 2017. 'Can Ceftazidime-Avibactam and Aztreonam Overcome beta-Lactam Resistance Conferred by Metallo-beta-Lactamases in Enterobacteriaceae?', Antimicrob Agents Chemother, 61.

Martinez-Martinez, L., and J. J. Gonzalez-Lopez. 2014. 'Carbapenemases in Enterobacteriaceae: types and molecular epidemiology', Enferm Infecc Microbiol Clin, 32 Suppl 4:4-9.

Maurer, F. P., Christner, M., Hentschke, M. & Rohde, H. Advances in Rapid Identification and Susceptibility Testing of Bacteria in the Clinical Microbiology Laboratory: Implications for Patient Care and Antimicrobial Stewardship Programs. Infect Dis Rep 9, 6839, doi: 10.4081/idr.2017.6839 (2017).

McArthur, A. G. et al. The comprehensive antibiotic resistance database. Antimicrob Agents Chemother 57, 3348-3357, doi: 10.1128/AAC.00419-13 (2013).

McMullen, A. R., Yarbrough, M. L., Wallace, M. A., Shupe, A. & Burnham, C. D. Evaluation of Genotypic and Phenotypic Methods to Detect Carbapenemase Production in Gram-Negative Bacilli. Clin Chem 63, 723-730, doi: 10.1373/clinchem.2016.264804 (2017).

Milheirico, C., de Lencastre, H. & Tomasz, A. Full-Genome Sequencing Identifies in the Genetic Background Several Determinants That Modulate the Resistance Phenotype in Methicillin-Resistant *Staphylococcus aureus* Strains Carrying the Novel mecC Gene. Antimicrob Agents Chemother 61, doi: 10.1128/AAC.02500-16 (2017).

Miller, S., and R. M. Humphries. 2016. 'Clinical laboratory detection of carbapenem-resistant and carbapenemase-producing Enterobacteriaceae', Expert Rev Anti Infect Ther, 14:705-17.

Nathan, C. & Cars, O. Antibiotic Resistance-Problems, Progress, and Prospects. N Engl J Med, doi: 10.1056/NEJMp1408040 (2014).

Nguyen, M. et al. Developing an in silico minimum inhibitory concentration panel test for *Klebsiella pneumoniae*. Sci Rep 8, 421, doi: 10.1038/s41598-017-18972-w (2018).

Nordmann, P., G. Cuzon, and T. Naas. 2009. 'The real threat of *Klebsiella pneumoniae* carbapenemase-producing bacteria', Lancet Infect Dis, 9:228-36.

Nordmann, P., L. Dortet, and L. Poirel. 2012. "Carbapenem resistance in Enterobacteriaceae: here is the storm!" Trends Mol Med, 18:263-72.

Paterson, D. L., W. C. Ko, A. Von Gottberg, J. M. Casellas, L. Mulazimoglu, K. P. Klugman, R. A. Bonomo, L. B. Rice, J. G. McCormack, and V. L. Yu. 2001. 'Outcome of cephalosporin treatment for serious infections due to apparently susceptible organisms producing extended-spectrum beta-lactamases: implications for the clinical microbiology laboratory', J Clin Microbiol, 39:2206-12.

Paterson, G. K., E. M. Harrison, and M. A. Holmes. 2014. 'The emergence of mecC methicillin-resistant *Staphylococcus aureus*', Trends Microbiol, 22:42-7.

Perez, K. K. et al. Integrating rapid pathogen identification and antimicrobial stewardship significantly decreases hospital costs. Arch Pathol Lab Med 137, 1247-1254, doi: 10.5858/arpa.2012-0651-OA (2013).

Quach, D. T., G. Sakoulas, V. Nizet, J. Pogliano, and K. Pogliano. 2016. 'Bacterial Cytological Profiling (BCP) as a Rapid and Accurate Antimicrobial Susceptibility Testing Method for *Staphylococcus aureus*', EBioMedicine, 4:95-103.

Rasko, D. A., D. R. Webster, J. W. Sahl, A. Bashir, N. Boisen, F. Scheutz, E. E. Paxinos, R. Sebra, C. S. Chin, D.

Iliopoulos, A. Klammer, P. Peluso, L. Lee, A. O. Kislyuk, J. Bullard, A. Kasarskis, S. Wang, J. Eid, D. Rank, J. C. Redman, S. R. Steyert, J. Frimodt-Moller, C. Struve, A. M. Petersen, K. A. Krogfelt, J. P. Nataro, E. E. Schadt, and M. K. Waldor. 2011. 'Origins of the *E. coli* strain causing an outbreak of hemolytic-uremic syndrome in Germany', N Engl J Med, 365:709-17.

Robnik-Šikonja, Marko, and Igor Kononenko. 2003. 'Theoretical and Empirical Analysis of ReliefF and RReliefF', Machine Learning, 53:23-69.

Rossen, J. W. A., A. W. Friedrich, J. Moran-Gilad, Escmid Study Group for Genomic, and Diagnostics Molecular. 2018. 'Practical issues in implementing whole-genome-sequencing in routine diagnostic microbiology', Clin Microbiol Infect, 24:355-60.

Salimnia, H. et al. Evaluation of the FilmArray Blood Culture Identification Panel: Results of a Multicenter Controlled Trial. J Clin Microbiol 54, 687-698, doi: 10.1128/JCM.01679-15 (2016).

Shishkin, A. A., G. Giannoukos, A. Kucukural, D. Ciulla, M. Busby, C. Surka, J. Chen, R. P. Bhattacharyya, R. F. Rudy, M. M. Patel, N. Novod, D. T. Hung, A. Gnirke, M. Garber, M. Guttman, and J. Livny. 2015. 'Simultaneous generation of many RNA-seq libraries in a single reaction', Nat Methods, 12:323-5.

Smith, K. P., and J. E. Kirby. 2018. 'The Inoculum Effect in the Era of Multidrug Resistance: Minor Differences in Inoculum Have Dramatic Effect on MIC Determination', Antimicrob Agents Chemother, 62.

Smith, M., B. Diederen, J. Scharringa, M. Leversteijn-van Hall, A. C. Fluit, and J. Cohen Stuart. 2016. 'Rapid and accurate detection of carbapenemase genes in Enterobacteriaceae with the Cepheid Xpert Carba-R assay', J Med Microbiol, 65:951-3.

Sullivan, K. V., B. Deburger, S. S. Roundtree, C. A. Ventrola, D. L. Blecker-Shelly, and J. E. Mortensen. 2014. 'Pediatric multicenter evaluation of the Verigene gram-negative blood culture test for rapid detection of inpatient bacteremia involving gram-negative organisms, extended-spectrum beta-lactamases, and carbapenemases', J Clin Microbiol, 52:2416-21.

Sun, J., H. Zhang, Y. H. Liu, and Y. Feng. 2018. 'Towards Understanding MCR-like Colistin Resistance', Trends Microbiol, 26:794-808.

Tacconelli, E. et al. Discovery, research, and development of new antibiotics: the WHO priority list of antibiotic-resistant bacteria and tuberculosis. Lancet Infect Dis 18, 318-327, doi: 10.1016/S1473-3099 (17) 30753-3 (2018).

Tagini, F., and G. Greub. 2017. 'Bacterial genome sequencing in clinical microbiology: a pathogen-oriented review', Eur J Clin Microbiol Infect Dis, 36:2007-20.

Tanner, H., Evans, J. T., Gossain, S. & Hussain, A. Evaluation of three sample preparation methods for the direct identification of bacteria in positive blood cultures by MALDI-TOF. BMC Res Notes 10, 48, doi: 10.1186/s13104-016-2366-y (2017).

Traczewski, M. M., Carretto, E., Canton, R., Moore, N. M. & Carba, R. S. T. Multicenter Evaluation of the Xpert Carba-R Assay for Detection of Carbapenemase Genes in Gram-Negative Isolates. J Clin Microbiol 56, doi: 10.1128/JCM.00272-18 (2018).

van Belkum, A., M. Welker, D. Pincus, J. P. Charrier, and V. Girard. 2017. 'Matrix-Assisted Laser Desorption Ionization Time-of-Flight Mass Spectrometry in Clinical Microbiology: What Are the Current Issues?', Ann Lab Med, 37:475-83.

van Duin, D., and R. A. Bonomo. 2016. 'Ceftazidime/Avibactam and Ceftolozane/Tazobactam: Second-generation beta-Lactam/beta-Lactamase Inhibitor Combinations', Clin Infect Dis, 63:234-41.

Vandesompele, J. et al. Accurate normalization of real-time quantitative RT-PCR data by geometric averaging of multiple internal control genes. Genome Biol 3, RESEARCH0034 (2002).

Wadsworth, C. B., Sater, M. R. A., Bhattacharyya, R. P. & Grad, Y. H. Impact of species diversity on the design of RNA-based diagnostics for antibiotic resistance in *Neisseria gonorrhoeae*. Antimicrob Agents Chemother, doi: 10.1128/AAC.00549-19 (2019).

Walker, G. T. et al. Analytical Performance of Multiplexed Screening Test for 10 Antibiotic Resistance Genes from Perianal Swab Samples. Clin Chem 62, 353-359, doi: 10.1373/clinchem.2015.246371 (2016).

Walker, T. et al. Clinical Impact of Laboratory Implementation of Verigene BC-GN Microarray-Based Assay for Detection of Gram-Negative Bacteria in Positive Blood Cultures. J Clin Microbiol 54, 1789-1796, doi: 10.1128/JCM.00376-16 (2016).

Weisenberg, S. A., D. J. Morgan, R. Espinal-Witter, and D. H. Larone. 2009. 'Clinical outcomes of patients with *Klebsiella pneumoniae* carbapenemase-producing *K. pneumoniae* after treatment with imipenem or meropenem', Diagn Microbiol Infect Dis, 64:233-5.

Wiegand, I., K. Hilpert, and R. E. Hancock. 2008. 'Agar and broth dilution methods to determine the minimal inhibitory concentration (MIC) of antimicrobial substances', Nat Protoc, 3:163-75.

Wolk, D. M. et al. Multicenter evaluation of the Cepheid Xpert methicillin-resistant *Staphylococcus aureus* (MRSA) test as a rapid screening method for detection of MRSA in nares. J Clin Microbiol 47, 758-764, doi: 10.1128/JCM.01714-08 (2009).

Woodworth, K. R., M. S. Walters, L. M. Weiner, J. Edwards, A. C. Brown, J. Y. Huang, S. Malik, R. B. Slayton, P. Paul, C. Capers, M. A. Kainer, N. Wilde, A. Shugart, G. Mahon, A. J. Kallen, J. Patel, L. C. McDonald, A. Srinivasan, M. Craig, and D. M. Cardo. 2018. 'Vital Signs: Containment of Novel Multidrug-Resistant Organisms and Resistance Mechanisms-United States, 2006-2017', MMWR Morb Mortal Wkly Rep, 67:396-401.

World Health_Organization. Antimicrobial resistance: global report on surveillance 2014. (2014).

Ye, Y., L. Xu, Y. Han, Z. Chen, C. Liu, and L. Ming. 2018. 'Mechanism for carbapenem resistance of clinical Enterobacteriaceae isolates', Exp Ther Med, 15:1143-49.

Zankari, E., H. Hasman, S. Cosentino, M. Vestergaard, S. Rasmussen, O. Lund, F. M. Aarestrup, and M. V. Larsen. 2012. 'Identification of acquired antimicrobial resistance genes', J Antimicrob Chemother, 67:2640-4.

Zhu, Y. Y., E. M. Machleder, A. Chenchik, R. Li, and P. D. Siebert. 2001. 'Reverse transcriptase template switching: a SMART approach for full-length cDNA library construction', Biotechniques, 30:892-7.

SEQUENCE LISTING (3648 sequences)

SEQ ID NO: 1 - DNA, 1284 bp, Artificial
  Synthetic
  misc_feature (159)..(1172): n is a, c, g, or t
  misc_feature (1284)..(1284): n is a, c, g, or t
atgaagaactggaaaacgctgcttctcggtatcgccatgatcgcgaataccagtttcgctgccccccaggtggtcgataaagtagcggccgtcgtcaataatggcgtcgtgctggaaagcgacgtcgatggtttgatgcaatcggttaagctcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaagatcgtgcttaccgcatgctgatgaaccgcaaattctctgaagaagcggcaacctggatgcaggaacagcgcgccagtgcgtatgttaaaattctgagcaactaan

SEQ ID NO: 2 - DNA, 1186 bp, Artificial
  Synthetic
  misc_feature (1)..(171): n is a, c, g, or t
  misc_feature (321)..(377): n is a, c, g, or t
  misc_feature (503)..(520): n is a, c, g, or t
  misc_feature (628)..(1186): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaatgcgtacagcgcgccatcgaccaggccgaactgatggcggattgccagatttcatcagtttatttggcactttcgggtaaacatataagctgtcagaatgaaatcgggatggtaccgatttcggaagaagaagtgacgcaggannnnnnnnnnnnnnnnnnnnnnnnnnnnnnnnnnnnnnnnnnnnnnnnnnnnnnnnngtcctgcacgtgattccgcaggaatatgctatcgactaccaggaagggattaaaaacccggtagggctgtccggcgtgcgtatgcaggcgaaggtgcatctgatcacctgccataacgatatggcnnnnnnnnnnnnnnnnnngtggaacgttgtggtctgaaagttgaccaacttattttcgccgggttagcggccagttattcggtattaacagaagacgaacgtgagctgggcgtctgcgttgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3 - DNA, 919 bp, Artificial
  Synthetic
  misc_feature (1)..(492): n is a, c, g, or t
  misc_feature (825)..(919): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgattgatgccagcacccagcgctatacgctgaacttctcggccgatgcgttcatgcgtcagattagccgtgcgcgtaccttcggttttatgcgcgatatcgaatatctgcagtcccgcggcctgtgcctgggcggcagcttcgattgtgccatcgttgttgacgattatcgcgtactgaacgaagacggtctgcgctttgaagacgaatttgttcgccacaaaatgctggatgcgatcggtgacctgtttatgtgtggtcacaacattatcggcgcattcacggcgtacaaatcgggtcacgcgttgaacaacaaactgctgcaggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4 - DNA, 747 bp, Artificial
  Synthetic
  misc_feature (213)..(747): n is a, c, g, or t
atgctggagttgttgtttctgcttttacccgttgccgccgcttacggctggtacatggggcgcagaagtgcacaacagtccaaacaggacgatgcgagccgcctgtcgcgagattacgtggcgggggttaacttcctgctcagcaaccagcaggataaagccgtcgacctgttccttgatatgctgaaagaggataccggtaccgttgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5 - DNA, 958 bp, Artificial
  Synthetic
  misc_feature (189)..(719): n is a, c, g, or t
  misc_feature (833)..(958): n is a, c, g, or t
atgaatactgaagccactcaagatcatcaagaagcaaacaccacgggcgcgcgtctgcgtcacgcccgcgaacaactcggacttagccagcaagcggtggccgaacgcttatgcctgaaggtgtccacggttcgtgatattgaagacgataaggcccccgccgacctcgcctccaccttcctgcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcggcgtcggcgcaggatctggtgatgaacttttccgccgactgctggctggaagtgagcgatgccaccggtaaaaaactgttcagcggcctgcagcgtaaaggcggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6 - DNA, 563 bp, Artificial
  Synthetic
  misc_feature (1)..(33): n is a, c, g, or t
  misc_feature (156)..(182): n is a, c, g, or t
  misc_feature (311)..(401): n is a, c, g, or t
  misc_feature (563)..(563): n is a, c, g, or t
nnnnnnnnnnnnnnnnnnnnnnnnnnnnnnnnnatggccggggaacacgtcattttgctggatgagcaggatcagcctgccggtatgctggagaagtatgccgcccatacgtttgatacccctttacatctcgcgttttcctgctggctgtttaannnnnnnnnnnnnnnnnnnnnnnnnnncgttcgttgggcaaaaaagcctggcccggggtatggaccaactcggtctgcggacacccccagcagggcgagaccttcgagcaggccgtcacgcgccgctgtcgcttcgaactcggtgtggagatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtggtaagcgaagtgcagcctaacgacgatgaagtcatggactatcagtgggttgacctggcaaccatgttaagcgcgctggccgccacgccgtgggcgttcagcccgtggatggtgctggaagcggaaaatcgggacgcccgccaggcgctgaccgan

SEQ ID NO: 7 - DNA, 1057 bp, Artificial
  Synthetic
  misc_feature (1)..(108): n is a, c, g, or t
  misc_feature (366)..(496): n is a, c, g, or t
  misc_feature (601)..(601): n is a, c, g, or t
  misc_feature (838)..(930): n is a, c, g, or t
  misc_feature (1057)..(1057): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgatacggcagacgactccccggcgagctataacgccgcggtgcgccgcgcggcgcccgccgtggtgaacgtctataaccgcgcccttaacagcaccagccataatcagctgacgcttggctcaggggtgattatggatcagcgcggctatatcctgaccaacaagcatgttatcaacgatgccgatcagattatcgtcgccctgcaggacggccgcgtcttcgaagcgctgctggtaggatccgattccctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggggattatcagcgccacagggcgcattggcctcaatccgaccggccgccagaacttcctgcagactgacgcctcgatcaaccacggtaactccggcggggcnctggtgaactccctcggcgagctgatggggattaacaccctctcctttgacaagagcaatgacggcgaaacgccggaaggcattggctttgcgatcccgttccagttagcgaccaaaattatggataaactgatccgcgatggccgggtgatccgcggctatatcggcattagcggccgggagatcgccccgctgcacgcgcagggcggagggatcgatcagattcaggggatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctggagacgatggatcaggtggccgagatccgcccgggatcggaaattccggtggtcatcatgcgtgatgataagaaaatcacgctccatatcgccgtccaggaatacccggccaccaactaan

SEQ ID NO: 8 - DNA, 1096 bp, Artificial
  Synthetic
  misc_feature (1)..(44): n is a, c, g, or t
  misc_feature (219)..(410): n is a, c, g, or t
  misc_feature (662)..(772): n is a, c, g, or t
  misc_feature (883)..(977): n is a, c, g, or t
  misc_feature (1096)..(1096): n is a, c, g, or t
nnnnnnnnnnnnnnnnnnnnnnnnnnnnnnnnnnnnnnnnnnnngttggcgatcctattcatcctgttactgattttcttttgtcagaaattagtcaggatcctcggcgccgcggtggatggcgatatcccaaccaatctggtgctctcgctgttggggctcggcatcccggagatggcgcagcttatcctgccgttaagtctgttccttggcctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccccggtatggcggcgctggcccagggccagttccagcaggccagcgatggtaacgcggtgatgtttatcgaaagcgtcaacggcaaccgcttccatgacgtcttccttgcccagctgcgtccgaaaggcaatgcgcgcccctcggtggtggtggcggattccggcgagctgtcgcagcagaaagacggctcgcaggtggtgaccctcaacaagggcacccgctttgaaggcaccgcgatgctgcgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgaccgcgcgcgcgccgaactgcactggcgcttcacgctggtggcgaccgtcttcattatggcgctgatggtggtgccgctcagcgtggtgaacccgcgtcagggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctatctggatgtgggcgattaacctgctctattttgcgctggcggtgctgttaaacctgtgggacacggtgccgatgcgccgcttccgcgcccgttttaataaaggagcggcctgan

SEQ ID NO: 9 - DNA, 486 bp, Artificial
  Synthetic
  misc_feature (1)..(242): n is a, c, g, or t
  misc_feature (392)..(486): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaacgccgcgcgatgcacgatctgatcgccagcgacaccttcgataaggcgaaggcggaagcgcagatcgataagatggaagcgcagcataaagcgatggcgctgtcccgcctggaaacgcagaacaagatctacaacattctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10 - DNA, 569 bp, Artificial
  Synthetic
  misc_feature (1)..(75): n is a, c, g, or t
  misc_feature (234)..(569): n is a, c, g, or t
nnnnnnnnnnnnnnnnnnnnnnnnnnnnnnnnnnnnnnnnnnnnnnnnnnnnnnnnnnnnnnnnnnnnnnnnnnngtggctgccgcgctgggcgttgcagctgtcgctggtctcaacgtgttggatcgcggcccgcagtatgcgcaagtggtctccagtacaccgattaaagaaaccgtgaaaacgccgcgtcaggaatgccgcaatgtcacggtgactcatcgtcgtccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11 - DNA, 878 bp, Artificial
  Synthetic
  misc_feature (183)..(878): n is a, c, g, or t
atgatgcgaatcgcgcttttcctgctgacgaacctggcagtgatggtcgtgttcgggctggtgttaagcctcacggggatccaatccagcagcatgaccggtcttctgattatggccctgctgttcggcttcggtggttctatcgtttcgctgatgatgtcgaagtggatggcgctgaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12 - DNA, 223 bp, Artificial
  Synthetic
  misc_feature (1)..(69): n is a, c, g, or t
  misc_feature (223)..(223): n is a, c, g, or t
nnnnnnnnnnnnnnnnnnnnnnnnnnnnnnnnnnnnnnnnnnnnnnnnnnnnnnnnnnnnnnnnnnnnnatcaccctgctgccatcggtaaaattacaaataggcgatcgtgacaattacggtaactactgggacggtggcagctggcgcgaccgtgattactggcgtcgtcactatgaatggcgtgataaccgttggcatcgtcatgacaacggctggcacn

SEQ ID NO: 13 - DNA, 277 bp, Artificial
  Synthetic
  misc_feature (277)..(277): n is a, c, g, or t
atgaaacgcaaaaacgcttcgttactcggtaacgtactcatggggttagggttggtggtgatggttgtgggggtaggttactccattctgaaccagcttccgcagcttaacctgccacaattctttgcgcatggcgcaatcctaagcatcttcgttggcgcagtgctctggctggccggtgcccgtattggcggccacgagcaggtcagcgaccgctactggtgggtgcgccactacgataaacgctgccgtcgtaaccagcatcgtcacagctaan

SEQ ID NO: 14 - DNA, 774 bp, Artificial
  Synthetic
  misc_feature (1)..(75): n is a, c, g, or t
  misc_feature (247)..(247): n is a, c, g, or t
  misc_feature (395)..(395): n is a, c, g, or t
  misc_feature (501)..(509): n is a, c, g, or t
  misc_feature (719)..(774): n is a, c, g, or t
nnnnnnnnnnnnnnnnnnnnnnnnnnnnnnnnnnnnnnnnnnnnnnnnnnnnnnnnnnnnnnnnnnnnnnnnnnnaacatggactccaacggtctgctcagctcaggcgccgaagccttccaggcatactctctcagcgacgcgcaggtgaaaaccttaagcgaccaggcctgtaaagagatggacgccaaagcgaaaatcgccccggccaacagtgaatacagccagcggctgaacaaaatcgcgnctgcgctgggcgataacatcaatggtcagcccgtgaactacaaggtctatgagaccaaggatgtcaacgccttcgccatggccaacggctgcatccgcgtctacagcgggctgatggatctgatgaacgataatgaagtcgaggcggngatcggccacgaaatgggccacgtcgcgctgggccacgtgaagaaaggcatgcaggtcgccctgggtaccaacgccgtgcgtgcggcggcggcctccgcgggcggnnnnnnnnnagcctgtcgcagtctcagttgggcgatctgggcgaaaaactggtgaactcgcagttctcccagcgtcaggaatcggaagcggatgactactcttacgacctgctgcgtaagcgcggtatcaatccgtcgggactggccaccagcttcgagaaactggccaagctggaagccggccgtcagagctccatgtttgacgatcacccggcatcnnnnnnnnnnnnnnnnnnnnnnnnnnnnnnnnnnnnnnnnnnnnnnnnnnnnnnnn

SEQ ID NO: 15 - DNA, 820 bp, Artificial
  Synthetic
  misc_feature (1)..(255): n is a, c, g, or t
  misc_feature (373)..(373): n is a, c, g, or t
  misc_feature (597)..(820): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccttatattaccaagcagaatcaggcgattactgcggatcgtaactggcttatttccaagcagtacgatgctcgctggtcgccgactgagaaggcgcgcctgaaggatatcgctncccgttataaggtgaagtggtcaggcaatacgcgtcatgtgccctggaacgcgctgcttgagcgtgtcgacattattccgaacagcatggtggcgaccatggcggcggcggaaagtggctggggtacctccaggctggcgcgcgagaataacaacctgttcggcatgaagtgcggcgccggtcgctgccgcggcgcgatgaaaggttactcgcagtttgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16 - DNA, 420 bp, Artificial
  Synthetic
  misc_feature (1)..(84): n is a, c, g, or t
  misc_feature (235)..(260): n is a, c, g, or t
  misc_feature (420)..(420): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnngccaatatcgatattgacgcctatctgcaactgcgaaaggccaaaggctacatgtcagtcagcgaaaatgaccatctgcgtgataacttgtttgagctttgccgtgaaatgcgtgcgcaggcgccgcgcctgcagaatgccatttcaccgnnnnnnnnnnnnnnnnnnnnnnnnnnggcgaatcggtcgccgccgctgcactatgcctgatgagcgggcatcatgattgtccgctatacatcgctgttaacgtagagaagctagaacgctgtctgacaggattgacctcaaatattcataaattgaataaattggcgccaatcactcatgcctgan

SEQ ID NO: 17 - DNA, 241 bp, Artificial
  Synthetic
  misc_feature (1)..(30): n is a, c, g, or t
  misc_feature (241)..(241): n is a, c, g, or t
nnnnnnnnnnnnnnnnnnnnnnnnnnnnnngtggctatcttatggattggcgtattattgagcggttatggggtgttattccacagtgaggaaaacgtcggcggtctgggtcttaagtgccaatacctcaccgcccgcggagtcagcaccgcactttatgttcattccgacagcggagtgatcggcgtcagcagttgccctctgctgcgtaaaagcacaaccgtggttgataacggctaan

SEQ ID NO: 18 - DNA, 261 bp, Artificial
  Synthetic
  misc_feature (1)..(107): n is a, c, g, or t
  misc_feature (261)..(261): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggcgtggtgtctgcgcaaggcgcaaccactttagatggtctggaagcaaaactggctgctaaagccgaagccgctggcgcgaccggctacagcattacttccgctaacaccaacaacaaactgagcggtactgcggttatctataaataan

SEQ ID NO: 19 - DNA, 852 bp, Artificial
  Synthetic
tatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttccgtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgaggga

SEQ ID NO: 20 - DNA, 811 bp, Artificial
  Synthetic
atggaattgcccaatattatgcacccggtcgcgaagctgagcaccgcattagccgctgcattgatgctgagcgggtgcatgcccggtgaaatccgcccgacgattggccagcaaatggaaactggcgaccaacggtttggcgatctggttttccgccagctcgcaccgaatgtctggcagcacacttcctatctcgacatgccgggtttcggggcagtcgcttccaacggtttgatcgtcagggatggcggccgcgtgctggtggtcgataccgcctggaccgatgaccagaccgcccagatcctcaactggatcaagcaggagatcaacctgccggtcgcgctggcggtggtgactcacgcgcatcaggacaagatgggcggtatggacgcgctgcatgcggcggggattgcgacttatgccaatgcgttgtcgaaccagcttgccccgcaagaggggatggttgcggcgcaacacagcctgactttcgccgccaatggctgggtcgaaccagcaaccgcgcccaactttggcccgctcaaggtattttaccccggccccggccacaccagtgacaatatcaccgttgggatcgacggcaccgacatcgcttttggtggctgcctgatcaaggacagcaaggccaagtcgctcggcaatctcggtgatgccgacactgagcactacgccgcgtcagcgcgcgcgtttggtgcggcgttccccaaggccagcatgatcgtgatgagccattccgcccccgatagccgcgccgcaatcactcatacggcccgcatggccgacaagctgcgct

SEQ ID NO: 21 - DNA, 796 bp, Artificial
  Synthetic
atgcgtgtattagccttatcggctgtgtttttggtggcatcgattatcggaatgcctgcggtagcaaaggaatggcaagaaaacaaaagttggaatgctcactttactgaacataaatcacagggcgtagttgtgctctggaatgagaataagcagcaaggatttaccaataatcttaaacgggcgaaccaagcatttttacccgcatctacctttaaaattcccaatagcttgatcgccctcgatttgggcgtggttaaggatgaacaccaagtctttaagtgggatggacagacgcgcgatatcgccacttggaatcgcgatcataatctaatcaccgcgatgaaatattcagttgtgcctgtttatcaagaatttgcccgccaaattggcgaggcacgtatgagcaagatgctacatgctttcgattatggtaatgaggacatttcgggcaatgtagacagtttctggctcgacggtggtattcgaatttcggccacggagcaaatcagctttttaagaaagctgtatcacaataagttacacgtatcggagcgcagccagcgtattgtcaaacaagccatgctgaccgaagccaatggtgactatattattcgggctaaaactggatactcgactagaatcgaacctaagattggctggtgggtcggttgggttgaacttgatgataatgtgtggttttttgcgatgaatatggatatgcccacatcggatggtttagggctgcgccaagccatcacaaaagaagtgctcaaacaggaaaaaattattccct

SEQ ID NO: 22 - DNA, 874 bp, Artificial
  Synthetic
atggttaaaaaatcactgcgccagttcacgctgatggcgacggcaaccgtcacgctgttgttaggaagtgtgccgctgtatgcgcaaacggcggacgtacagcaaaaacttgccgaattagagcggcagtcgggaggcagactgggtgtggcattgattaacacagcagataattcgcaaatactttatcgtgctgatgagcgctttgcgatgtgcagcaccagtaaagtgatggccgcggccgcggtgctgaagaaaagtgaaagcgaaccgaatctgttaaatcagcgagttgagatcaaaaaatctgaccttgttaactataatccgattgcggaaaagcacgtcaatgggacgatgtcactggctgagcttagcgcggccgcgctacagtacagcgataacgtggcgatgaataagctgattgctcacgttggcggcccggctagcgtcaccgcgttcgcccgacagctgggagacgaaacgttccgtctcgaccgtaccgagccgacgttaaacaccgccattccgggcgatccgcgtgataccacttcacctcgggcaatggcgcaaactctgcggaatctgacgctgggtaaagcattgggcgacagccaacgggcgcagctggtgacatggatgaaaggcaataccaccggtgcagcgagcattcaggctggactgcctgcttcctgggttgtgggggataaaaccggcagcggtggctatggcaccaccaacgatatcgcggtgatctggccaaaagatcgtgcgccgctgattctggtcacttacttcacccagcctcaacctaaggcagaaagccgtcgcgatgtattagcgtcggcggctaaaatcgtcaccgacggtttgt

SEQ ID NO: 23 - DNA, 799 bp, Artificial
  Synthetic
atgaaaacatttgccgcatatgtaattatcgcgtgtctttcgagtacggcattagctggttcaattacagaaaatacgtcttggaacaaagagttctctgccgaagccgtcaatggtgtcttcgtgctttgtaaaagtagcagtaaatcctgcgctaccaatgacttagctcgtgcatcaaaggaatatcttccagcatcaacatttaagatccccaacgcaattatcggcctagaaactggtgtcataaagaatgagcatcaggttttcaaatgggacggaaagccaagagccatgaagcaatgggaaagagacttgaccttaagaggggcaatacaagtttcagctgttcccgtatttcaacaaatcgccagagaagttggcgaagtaagaatgcagaaataccttaaaaaattttcctatggcaaccagaatatcagtggtggcattgacaaattctggttggaaggccagcttagaatttccgcagttaatcaagtggagtttctagagtctctatatttaaataaattgtcagcatctaaagaaaaccagctaatagtaaaagaggctttggtaacggaggcggcacctgaatatctagtgcattcaaaaactggtttttctggtgtgggaactgagtcaaatcctggtgtcgcatggtgggttgggtgggttgagaaggagacagaggtttactttttcgcctttaacatggatatagacaacgaaagtaagttgccgctaagaaaatccattcccaccaaaatcatggaaagtgagggcatcattggtggct

SEQ ID NO: 24 - DNA, 799 bp, Artificial
  Synthetic
  misc_feature (10)..(12): n is a, c, g, or t
atgtttcaannnattcgcagctttctggttggtatcagtgcattcgtcatggccgtacttggatcagcagcatattccgcacagcctggcggtgaatatccgacagtagatgacataccggtaggggaagttcggctgtacaagattggcgatggcgtttggtcgcatatcgcaactcagaaactcggtgacacggtgtactcgtctaatggacttatcgtccgcgatgctgatgagttgcttcttattgatacagcgtggggggcgaagaacacggtagcccttctcgcggagattgaaaagcaaattggacttccagtaacgcgctcaatttctacgcacttccatgacgatcgagtcggtggagttgatgtcctccgggcggctggagtggcaacgtacacctcacccttgacacgccagctggccgaagcggcgggaaacgaggtgcctgcgcactctctaaaagcgctctcctctagtggagatgtggtgcgcttcggtcccgtagaggttttctatcctggtgctgcgcattcgggcgacaatcttgtggtatacgtgccggccgtgcgcgtactgtttggtggctgtgcagttcatgaggcgtcacgcgaatccgcgggtaatgttgccgatgccaatttggcagaatggcctgctaccattaaacgaattcaacagcggtatccggaagcagaggtcgtcatccccggccacggtctaccgggcggtctggaattgctccaacacacaactaacgttgtcaaaacgcacaaagtacgcccggtggccgagt

SEQ ID NO: 25 - DNA, 348 bp, Artificial
  Synthetic
cgagtggtgagtatccgacagtcaacgaaattccggtcggagaggtccggctttaccagattgccgatggtgtttggtcgcatatcgcaacgcagtcgtttgatggcgcggtctacccgtccaatggtctcattgtccgtgatggtgatgagttgcttttgattgatacagcgtggggtgcgaaaaacacagcggcacttctcgcggagattgagaagcaaattggacttcccgtaacgcgtgcagtctccacgcactttcatgacgaccgcgtcggcggcgttgatgtccttcgggcggctggggtggcaacgtacgcatcaccgtcgacacgccggctagccgagg

SEQ ID NO: 26 - DNA, 166 bp, Artificial
  Synthetic
tacccgtccaatggtctcattgtccgtgatggtgatgagttgcttttgattgatacagcgtggggtgcgaaaaacacagcggcacttctcgcggagattgagaagcaaattggacttcccgtaacgcgtgcagtctccacgcactttcatgacgaccgcgtcggcg

SEQ ID NO: 27 - DNA, 153 bp, Artificial
  Synthetic
ggagcggctttgcctgatttaaaaatcgagaagcttgaagaaggtgtttatgttcatacatcgttcgaagaagttaacggttggggtgttgtttctaaacacggtttggtggttcttgtaaacactgacgcctatctgattgacactccattt

SEQ ID NO: 28 - DNA, 150 bp, Artificial
  Synthetic
  misc_feature (87)..(87): n is a, c, g, or t
actgaaaagttagtcaattggtttgtggagcgcggctataaaatcaaaggcactatttcctcacatttccatagcgacagcacaggnggaatagagtggcttaattctcaatctattcccacgtatgcatctgaattaacaaatgaactt

SEQ ID NO: 29 - DNA, 157 bp, Artificial
  Synthetic
tcatttagcggagttagttattggctagttaaaaataaaattgaagttttttatcccggcccggggcacactcaagataacgtagtggtttggttacctgaaaagaaaattttattcggtggttgttttgttaaaccggacggtcttggtaatttgg

SEQ ID NO: 30 - DNA, 150 bp, Artificial
  Synthetic
ctgacgcctatctgattgacactccatttactgctacagatactgaaaagttagtcaattggtttgtggagcgcggctataaaatcaaaggcactatttcctcacatttccatagcgacagcacagggggaatagagtggcttaattctc

SEQ ID NO: 31 - DNA, 738 bp, Artificial
  Synthetic
atgaaaaaaatatttgtgttatttgtatttttgttttgcagtattactgccgccggagagtctttgcctgatataaaaattgagaaacttgacgaagatgtttatgttcatacttcttttgaaaaaaaaaacggctggggtgttattactaaacacggcttggtggttcttgtaaatactgatgcctatataattgacactccatttacagctaaagatactgaaaaattagtccgctggtttgtggggcgtggttataaaatcaaaggcagtatttcctcacattttcatagcgatagcgcaggtggaattgagtggcttaattctcaatctatccccacatatgcatctaaattaacaaatgagcttcttaaaaagaacggtaatgcgcaagccgaaaactcatttagtggcgttagctattggctagttaaacataaaattgaagttttctatccaggaccagggcacactcaggataatgtagtggtttggttgcctgaaaagaaaattttatttggcggttgttttattaagccggacggtcttggttatttgggagacgcaaatctagaagcatggcctaagtccgcagaaacattaatgtctaagtatggtaatgcaaaactggttgtttcgagtcatagtgaaattgggggcgcatcactattgaagcgcacttgggagcaggctgttaaggggctaaaagaaagtaaaaaaccatcacagccaaacaaa

SEQ ID NO: 32 - DNA, 186 bp, Artificial
  Synthetic
ctgaggcttatctaattgacactccatttacggctaaagatactgaaaagttagtcacttggtttgtggaacgtggctataaaataaaaggcagtatttcctctcattttcatagcgacagcacgggcggaatagagtggcttaattctcaatctatccccacgtatgcatctgaattaacaaatg

SEQ ID NO: 33 - DNA, 154 bp, Artificial
  Synthetic
tatgcatctgaattaacaaatgaacttcttaaaaaagacggtaaggtacaagctaaaaattcatttagcggagttagctattggctagttaagaaaaagattgaagttttttatcctggtccagggcacactccagataacgtagtggtttggc

SEQ ID NO: 34 - DNA, 151 bp, Artificial
  Synthetic
gggcacactcaagataacgtagtggtttggttacctgaaaagaaaattttattcggtggttgttttgttaaaccggacggtcttggtaatttgggtgacgcaaatttagaagcttggccaaagtccgccaaaatattaatgtctaaatatg

SEQ ID NO: 35 - DNA, 100 bp, Artificial
  Synthetic
accagtcaataaataaagcgttccctcatgccgatactctgaaaggtgttcagctgggatggagtgggaatgtttatcagtcggttcgaattaacacttc

SEQ ID NO: 36 - DNA, 100 bp, Artificial
  Synthetic
aaaaaactaatctatatattgctaataccaattgcaggcttagcagtttttgcaatttttcaggagaggctgtcgcatgatggttatacatcatatgaac

SEQ ID NO: 37 - DNA, 100 bp, Artificial
  Synthetic
aaaccttcctattcctctgagcaggtagttctggctcgtatcaatcagcgactgtcagcgttaaaagccgatttccgggtcaccggctatacctcgaccg

SEQ ID NO: 38 - DNA, 100 bp, Artificial
  Synthetic
gccaacatttatcagctataaagcgcaactttactttgacctgaatacggaaggagaccttaaaagagttacagcagttgcaatgggatttggaagtctt

SEQ ID NO: 39 - DNA, 100 bp, Artificial
  Synthetic
acccatctcggaaaaatatctgacaacaggcatgacggtggcggagctgtccgcggccgccgtgcaatacagtgataacgccgccgccaatttgttgctg

SEQ ID NO: 40 - DNA, 100 bp, Artificial
  Synthetic
caaatggaaactggcgaccaacggtttggcgatctggttttccgccagctcgcaccgaatgtctggcagcacacttcctatctcgacatgccgggtttcg

SEQ ID NO: 41 - DNA, 100 bp, Artificial
  Synthetic
tgctacatgctttcgattatggtaatgaggacatttcgggcaatgtagacagtttctggctcgacggtggtattcgaatttcggccacggagcaaatcag

SEQ ID NO: 42 - DNA, 100 bp, Artificial
  Synthetic
agtgaaagcgaaccgaatctgttaaatcagcgagttgagatcaaaaaatctgaccttgttaactataatccgattgcggaaaagcacgtcaatgggacga

SEQ ID NO: 43 - DNA, 100 bp, Artificial
  Synthetic
gaagaaggtgtttatgttcatacatcgttcgaagaagttaacggttggggtgttgtttctaaacacggtttggtggttcttgtaaacactgacgcctatc

SEQ ID NO: 44 - DNA, 100 bp, Artificial
  Synthetic
gttttttatcccggcccggggcacactcaagataacgtagtggtttggttacctgaaaagaaaattttattcggtggttgttttgttaaaccggacggtc

SEQ ID NO: 45 - DNA, 100 bp, Artificial
  Synthetic
gaaaagttagtcaattggtttgtggagcgcggctataaaatcaaaggcactatttcctcacatttccatagcgacagcacagggggaatagagtggctta

SEQ ID NO: 46 - DNA, 100 bp, Artificial
  Synthetic
aagtatggtaatgcaaaactggttgtttcgagtcatagtgaaattgggggcgcatcactattgaagcgcacttgggagcaggctgttaaggggctaaaag

SEQ ID NO: 47 - DNA, 100 bp, Artificial
  Synthetic
gaaaagttagtcacttggtttgtggaacgtggctataaaataaaaggcagtatttcctctcattttcatagcgacagcacgggcggaatagagtggctta

SEQ ID NO: 48 - DNA, 100 bp, Artificial
  Synthetic
tatgcatctgaattaacaaatgaacttcttaaaaaagacggtaaggtacaagctaaaaattcatttagcggagttagctattggctagttaagaaaaaga

SEQ ID NO: 49 - DNA, 100 bp, Artificial
  Synthetic
ctctagtggagatgtggtgcgcttcggtcccgtagaggttttctatcctggtgctgcgcattcgggcgacaatcttgtggtatacgtgccggccgtgcgc

SEQ ID NO: 50 - DNA, 100 bp, Artificial
  Synthetic
tgatggtgatgagttgcttttgattgatacagcgtggggtgcgaaaaacacagcggcacttctcgcggagattgagaagcaaattggacttcccgtaacg

SEQ ID NO: 51 - DNA, 100 bp, Artificial
  Synthetic
cataaagaatgagcatcaggttttcaaatgggacggaaagccaagagccatgaagcaatgggaaagagacttgaccttaagaggggcaatacaagtttca

SEQ ID NO: 52 - DNA, 100 bp, Artificial
  Synthetic
agatcgtgcttaccgcatgctgatgaaccgcaaattctctgaagaagcggcaacctggatgcaggaacagcgcgccagtgcgtatgttaaaattctgagc

SEQ ID NO: 53 - DNA, 100 bp, Artificial
  Synthetic
ggaacgttgtggtctgaaagttgaccaacttattttcgccgggttagcggccagttattcggtattaacagaagacgaacgtgagctgggcgtctgcgtt

SEQ ID NO: 54 - DNA, 100 bp, Artificial
  Synthetic
tcgattgtgccatcgttgttgacgattatcgcgtactgaacgaagacggtctgcgctttgaagacgaatttgttcgccacaaaatgctggatgcgatcgg

SEQ ID NO: 55 - DNA, 100 bp, Artificial
  Synthetic
atgctggagttgttgtttctgcttttacccgttgccgccgcttacggctggtacatggggcgcagaagtgcacaacagtccaaacaggacgatgcgagcc

SEQ ID NO: 56 - DNA, 100 bp, Artificial
  Synthetic
gcgcaggatctggtgatgaacttttccgccgactgctggctggaagtgagcgatgccaccggtaaaaaactgttcagcggcctgcagcgtaaaggcggta

SEQ ID NO: 57 - DNA, 100 bp, Artificial
  Synthetic
atggccggggaacacgtcattttgctggatgagcaggatcagcctgccggtatgctggagaagtatgccgcccatacgtttgatacccctttacatctcg

SEQ ID NO: 58 - DNA, 100 bp, Artificial
  Synthetic
agcaatgacggcgaaacgccggaaggcattggctttgcgatcccgttccagttagcgaccaaaattatggataaactgatccgcgatggccgggtgatcc

SEQ ID NO: 59 - DNA, 100 bp, Artificial
  Synthetic
caggccagcgatggtaacgcggtgatgtttatcgaaagcgtcaacggcaaccgcttccatgacgtcttccttgcccagctgcgtccgaaaggcaatgcgc

SEQ ID NO: 60 - DNA, 100 bp, Artificial
  Synthetic
gcgcgatgcacgatctgatcgccagcgacaccttcgataaggcgaaggcggaagcgcagatcgataagatggaagcgcagcataaagcgatggcgctgtc

SEQ ID NO: 61 - DNA, 100 bp, Artificial
  Synthetic
gctgtcgctggtctcaacgtgttggatcgcggcccgcagtatgcgcaagtggtctccagtacaccgattaaagaaaccgtgaaaacgccgcgtcaggaat

SEQ ID NO: 62 - DNA, 100 bp, Artificial
  Synthetic
atgcgaatcgcgcttttcctgctgacgaacctggcagtgatggtcgtgttcgggctggtgttaagcctcacggggatccaatccagcagcatgaccggtc

SEQ ID NO: 63 - DNA, 100 bp, Artificial
  Synthetic
caaataggcgatcgtgacaattacggtaactactgggacggtggcagctggcgcgaccgtgattactggcgtcgtcactatgaatggcgtgataaccgtt

SEQ ID NO: 64 - DNA, 100 bp, Artificial
  Synthetic
gggtaggttactccattctgaaccagcttccgcagcttaacctgccacaattctttgcgcatggcgcaatcctaagcatcttcgttggcgcagtgctctg

SEQ ID NO: 65 - DNA, 100 bp, Artificial
  Synthetic
gggcgaaaaactggtgaactcgcagttctcccagcgtcaggaatcggaagcggatgactactcttacgacctgctgcgtaagcgcggtatcaatccgtcg

SEQ ID NO: 66 - DNA, 100 bp, Artificial
  Synthetic
tgccttatattaccaagcagaatcaggcgattactgcggatcgtaactggcttatttccaagcagtacgatgctcgctggtcgccgactgagaaggcgcg

SEQ ID NO: 67 - DNA, 100 bp, Artificial
  Synthetic
tgcaactgcgaaaggccaaaggctacatgtcagtcagcgaaaatgaccatctgcgtgataacttgtttgagctttgccgtgaaatgcgtgcgcaggcgcc

SEQ ID NO: 68 - DNA, 100 bp, Artificial
  Synthetic
tatggggtgttattccacagtgaggaaaacgtcggcggtctgggtcttaagtgccaatacctcaccgcccgcggagtcagcaccgcactttatgttcatt

SEQ ID NO: 69 - DNA, 100 bp, Artificial
  Synthetic
aaccactttagatggtctggaagcaaaactggctgctaaagccgaagccgctggcgcgaccggctacagcattacttccgctaacaccaacaacaaactg

SEQ ID NO: 70 - DNA, 85 bp, Artificial
  Synthetic
aacacctttcagagtatcggcatgagggaacgctttatttattgactggtcctcaagacctaagcgacagcgtgaccttgtttca

SEQ ID NO: 71 - DNA, 85 bp, Artificial
  Synthetic
aaaactgctaagcctgcaattggtattagcaatatatagattagttttttcatcctcttcttttcttggtgttgagaagatgctc

SEQ ID NO: 72 - DNA, 85 bp, Artificial
  Synthetic
cgctgattgatacgagccagaactacctgctcagaggaataggaaggtttcacaattctgcgggttagcaggaaggttagggaac

SEQ ID NO: 73 - DNA, 85 bp, Artificial
  Synthetic
ccgtattcaggtcaaagtaaagttgcgctttatagctgataaatgttggcctgttgagattattgagcttcatcatgaccagaag

SEQ ID NO: 74 - DNA, 70 bp, Artificial
  Synthetic
acagctccgccaccgtcatgcctgttgtcagatatcaaagacgcctatcttccagtttgatcgggaaact

SEQ ID NO: 75 - DNA, 85 bp, Artificial
  Synthetic
agctggcggaaaaccagatcgccaaaccgttggtcgccagtttccatttgcgaacctaactcctcgctacattcctattgttttc

SEQ ID NO: 76 - DNA, 85 bp, Artificial
  Synthetic
gtctacattgcccgaaatgtcctcattaccataatcgaaagcatgtagcaccaatttggttttactcccctcgattatgcggagt

SEQ ID NO: 77 - DNA, 85 bp, Artificial
  Synthetic
gattttttgatctcaactcgctgatttaacagattcggttcgctttcactctttcgggttatatctatcatttacttgacaccct

SEQ ID NO: 78 - DNA, 85 bp, Artificial
  Synthetic
ccccaaccgttaacttcttcgaacgatgtatgaacataaacaccttcttccaacagccactttttttccaaattttgcaagagcc

SEQ ID NO: 79 - DNA, 85 bp, Artificial
  Synthetic
aaccaaaccactacgttatcttgagtgtgccccgggccgggataaaaaaccaccgtgtggacggcaactcagagataacgcatat

SEQ ID NO: 80 - DNA, 85 bp, Artificial
  Synthetic
gtgcctttgattttatagccgcgctccacaaaccaattgactaacttttccctggagtttatgtattgccaacgagtttgtcttt

SEQ ID NO: 81 - DNA, 85 bp, Artificial
  Synthetic
cccccaatttcactatgactcgaaacaaccagttttgcattaccatacttcagataaggttgttattgtggaggatgttactaca

SEQ ID NO: 82 - DNA, 85 bp, Artificial
  Synthetic
ctgccttttattttatagccacgttccacaaaccaagtgactaacttttccttccttcctgtgttccagctacaaacttagaaac

SEQ ID NO: 83 - DNA, 85 bp, Artificial
  Synthetic
tgtaccttaccgtcttttttaagaagttcatttgttaattcagatgcatacataaaattggttttgcctttcagcaattcaactt

SEQ ID NO: 84 - DNA, 78 bp, Artificial
  Synthetic
gaaaacctctacgggaccgaagcgcaccacatctccactagagctggtcaagacttgcatgaggacccgcaaattcct

SEQ ID NO: 85 - DNA, 78 bp, Artificial
  Synthetic
cgcaccccacgctgtatcaatcaaaagcaactcatcaccatcactttcgttgggacgcttgaagcgcaagtagaaaac

SEQ ID NO: 86 - DNA, 85 bp, Artificial
  Synthetic
tggctcttggctttccgtcccatttgaaaacctgatgctcattctttatgccagcagacctgcaatatcaaagttataagcgcgt

SEQ ID NO: 87 - DNA, 75 bp, Artificial
  Synthetic
cgaaagccatgacctccgatcactcgaagtgttaattcgaaccgactgataaacattcccactccatcccagctg

SEQ ID NO: 88 - DNA, 75 bp, Artificial
  Synthetic
cgaaagccatgacctccgatcactcgttcatatgatgtataaccatcatgcgacagcctctcctgaaaaattgca

SEQ ID NO: 89 - DNA, 75 bp, Artificial
  Synthetic
cgaaagccatgacctccgatcactccggtcgaggtatagccggtgacccggaaatcggcttttaacgctgacagt

SEQ ID NO: 90 - DNA, 75 bp, Artificial
  Synthetic
cgaaagccatgacctccgatcactcaagacttccaaatcccattgcaactgctgtaactcttttaaggtctcctt

SEQ ID NO: 91 - DNA, 75 bp, Artificial
  Synthetic
cgaaagccatgacctccgatcactccagcaacaaattggcggcggcgttatcactgtattgcacggcggccgcgg

SEQ ID NO: 92 - DNA, 75 bp, Artificial
  Synthetic
cgaaagccatgacctccgatcactccgaaacccggcatgtcgagataggaagtgtgctgccagacattcggtgcg

SEQ ID NO: 93 - DNA, 75 bp, Artificial
  Synthetic
cgaaagccatgacctccgatcactcctgatttgctccgtggccgaaattcgaataccaccgtcgagccagaaact

SEQ ID NO: 94 - DNA, 75 bp, Artificial
  Synthetic
cgaaagccatgacctccgatcactctcgtcccattgacgtgcttttccgcaatcggattatagttaacaaggtca

SEQ ID NO: 95 - DNA, 75 bp, Artificial
  Synthetic
cgaaagccatgacctccgatcactcgataggcgtcagtgtttacaagaaccaccaaaccgtgtttagaaacaaca

SEQ ID NO: 96 - DNA, 75 bp, Artificial
  Synthetic
cgaaagccatgacctccgatcactcgaccgtccggtttaacaaaacaaccaccgaataaaattttcttttcaggt

SEQ ID NO: 97 - DNA, 75 bp, Artificial
  Synthetic
cgaaagccatgacctccgatcactctaagccactctattccccctgtgctgtcgctatggaaatgtgaggaaata

SEQ ID NO: 98 - DNA, 67 bp, Artificial
  Synthetic
cgaaagccatgacctccgatcactccccttaacagcctgctcccaagtgcgcttcaatagtgatgcg

SEQ ID NO: 99 - DNA, 75 bp, Artificial
  Synthetic
cgaaagccatgacctccgatcactctaagccactctattccgcccgtgctgtcgctatgaaaatgagaggaaata

SEQ ID NO: 100 - DNA, 75 bp, Artificial
  Synthetic
cgaaagccatgacctccgatcactctctttttcttaactagccaatagctaactccgctaaatgaatttttagct

SEQ ID NO: 101 - DNA, 68 bp, Artificial
  Synthetic
cgaaagccatgacctccgatcactccgtataccacaagattgtcgcccgaatgcgcagcaccaggata

SEQ ID NO: 102 - DNA, 68 bp, Artificial
  Synthetic
cgaaagccatgacctccgatcactccaatttgcttctcaatctccgcgagaagtgccgctgtgttttt

SEQ ID NO: 103 - DNA, 75 bp, Artificial
  Synthetic
cgaaagccatgacctccgatcactctgaaacttgtattgcccctcttaaggtcaagtctctttcccattgcttca

SEQ ID NO: 104 - DNA, 83 bp, Artificial
  Synthetic
ccgcttcttcagagaatttgcggttcatcagcatgcggtaagcacgatcctgccaatgcactcgatcttgtcatttttttgcg

SEQ ID NO: 105 - DNA, 85 bp, Artificial
  Synthetic
ccgctaacccggcgaaaataagttggtcaactttcagaccacaacgttcccaaactggagagagaagtgaagacgatttaaccca

SEQ ID NO: 106 - DNA, 85 bp, Artificial
  Synthetic
accgtcttcgttcagtacgcgataatcgtcaacaacgatggcacaatcgacgattgctgcattccgctcaacgcttgaggaagta

SEQ ID NO: 107 - DNA, 85 bp, Artificial
  Synthetic
cagccgtaagcggcggcaacgggtaaaagcagaaacaacaactccagcatctgaggctgttaaagctgtagcaactcttccacga

SEQ ID NO: 108 - DNA, 77 bp, Artificial
  Synthetic
ctcacttccagccagcagtcggcggaaaagttcatcaccagactaggacgcaaatcacttgaagaagtgaaagcgag

SEQ ID NO: 109 - DNA, 77 bp, Artificial
  Synthetic
ccggcaggctgatcctgctcatccagcaaaatgacgtgttccccacgcgatgacgttcgtcaagagtcgcataatct

SEQ ID NO: 110 - DNA, 77 bp, Artificial
  Synthetic
tggaacgggatcgcaaagccaatgccttccggcgtttcgccgcatttggaatgatgtgtactgggaataagacgacg

SEQ ID NO: 111 - DNA, 85 bp, Artificial
  Synthetic
ttgccgttgacgctttcgataaacatcaccgcgttaccatcgctggcctgcacaagaatccctgctagctgaaggagggtcaaac

SEQ ID NO: 112 - DNA, 77 bp, Artificial
  Synthetic
cgccttcgccttatcgaaggtgtcgctggcgatcagatcgtgcttgacgtagattgctatcaggttacgatgactgc

SEQ ID NO: 113 - DNA, 77 bp, Artificial
  Synthetic
acttgcgcatactgcgggccgcgatccaacacgttgagaccacttacagatcgtgtgctcatgacttccacagacgt

SEQ ID NO: 114 - DNA, 85 bp, Artificial
  Synthetic
aacacgaccatcactgccaggttcgtcagcaggaaaagcgcgattcgcatcttggaggagttgatagtggtaaaacaacattagc

SEQ ID NO: 115 - DNA, 77 bp, Artificial
  Synthetic
cagctgccaccgtcccagtagttaccgtaattgtcacgatcgcctacgtatatatccaagtggttatgtccgacggc

SEQ ID NO: 116 - DNA, 83 bp, Artificial
  Synthetic
ttgtggcaggttaagctgcggaagctggttcagaatggagtaacctaccagcaagaaggagtatggaacttatagcaagagag

SEQ ID NO: 117 - DNA, 77 bp, Artificial
  Synthetic
cttccgattcctgacgctgggagaactgcgagttcaccagttcacccctccaaacgcattcttattggcaaatggaa

SEQ ID NO: 118 - DNA, 85 bp, Artificial
  Synthetic
ccagttacgatccgcagtaatcgcctgattctgcttggtaatataaggcacccgaagcaatactgtcgtcactctgtatgtccgt

SEQ ID NO: 119 - DNA, 77 bp, Artificial
  Synthetic
atggtcattttcgctgactgacatgtagcctttggcctttcgccgggaatcggcatttcgcattcttaggatctaaa

SEQ ID NO: 120 - DNA, 85 bp, Artificial
  Synthetic
ttaagacccagaccgccgacgttttcctcactgtggaataacaccccataccgatcttcataacggacaaactgaacgggccatt

SEQ ID NO: 121 - DNA, 80 bp, Artificial
  Synthetic
cggcttcggctttagcagccagttttgcttccagaccatctaaagcgctatgcagacgagctggcagaggagagaaatca

SEQ ID NO: 122 - DNA, 72 bp, Artificial
  Synthetic
cgaaagccatgacctccgatcactccagaattttaacatacgcactggcgcgctgttcctgcatccaggttg

SEQ ID NO: 123 - DNA, 75 bp, Artificial
  Synthetic
cgaaagccatgacctccgatcactcaacgcagacgcccagctcacgttcgtcttctgttaataccgaataactgg

SEQ ID NO: 124 - DNA, 75 bp, Artificial
  Synthetic
cgaaagccatgacctccgatcactcccgatcgcatccagcattttgtggcgaacaaattcgtcttcaaagcgcag

SEQ ID NO: 125 - DNA, 60 bp, Artificial
  Synthetic
cgaaagccatgacctccgatcactcgtttggactgttgtgcacttctgcgccccatgtac

SEQ ID NO: 126 - DNA, 67 bp, Artificial
  Synthetic
cgaaagccatgacctccgatcactcttacgctgcaggccgctgaacagttttttaccggtggcatcg

SEQ ID NO: 127 - DNA, 75 bp, Artificial
  Synthetic
cgaaagccatgacctccgatcactccgagatgtaaaggggtatcaaacgtatgggcggcatacttctccagcata

SEQ ID NO: 128 - DNA, 75 bp, Artificial
  Synthetic
cgaaagccatgacctccgatcactcggatcacccggccatcgcggatcagtttatccataattttggtcgctaac

SEQ ID NO: 129 - DNA, 71 bp, Artificial
  Synthetic
cgaaagccatgacctccgatcactcattgcctttcggacgcagctgggcaaggaagacgtcatggaagcgg

SEQ ID NO: 130 - DNA, 67 bp, Artificial
  Synthetic
cgaaagccatgacctccgatcactccatcgctttatgctgcgcttccatcttatcgatctgcgcttc

SEQ ID NO: 131 - DNA, 71 bp, Artificial
  Synthetic
cgaaagccatgacctccgatcactcctgacgcggcgttttcacggtttctttaatcggtgtactggagacc

SEQ ID NO: 132 - DNA, 61 bp, Artificial
  Synthetic
cgaaagccatgacctccgatcactcctggattggatccccgtgaggcttaacaccagcccg

SEQ ID NO: 133 - DNA, 75 bp, Artificial
  Synthetic
cgaaagccatgacctccgatcactcaacggttatcacgccattcatagtgacgacgccagtaatcacggtcgcgc

SEQ ID NO: 134 - DNA, 75 bp, Artificial
  Synthetic
cgaaagccatgacctccgatcactccagagcactgcgccaacgaagatgcttaggattgcgccatgcgcaaagaa

SEQ ID NO: 135 - DNA, 75 bp, Artificial
  Synthetic
cgaaagccatgacctccgatcactccgacggattgataccgcgcttacgcagcaggtcgtaagagtagtcatccg

SEQ ID NO: 136 - DNA, 71 bp, Artificial
  Synthetic
cgaaagccatgacctccgatcactcccttctcagtcggcgaccagcgagcatcgtactgcttggaaataag

SEQ ID NO: 137 - DNA, 75 bp, Artificial
  Synthetic
cgaaagccatgacctccgatcactcggcgcctgcgcacgcatttcacggcaaagctcaaacaagttatcacgcag

SEQ ID NO: 138 - DNA, 75 bp, Artificial
  Synthetic
cgaaagccatgacctccgatcactcaatgaacataaagtgcggtgctgactccgcgggcggtgaggtattggcac

SEQ ID NO: 139 - DNA, 65 bp, Artificial
  Synthetic
cgaaagccatgacctccgatcactcttggtgttagcggaagtaatgctgtagccggtcgcgccag

SEQ ID NO: 140 - DNA, 100 bp, Artificial; identical to SEQ ID NO: 52
  Synthetic

SEQ ID NO: 141 - DNA, 100 bp, Artificial; identical to SEQ ID NO: 53
  Synthetic

SEQ ID NO: 142 - DNA, 100 bp, Artificial; identical to SEQ ID NO: 54
  Synthetic

SEQ ID NO: 143 - DNA, 100 bp, Artificial
  Synthetic
agtgctgtggtatggcgagaaaatccatgtcgccgtggcggccgaagtgcccggcaccggcgtggataccccggaagatctggagcgcgtccgcgctgag

SEQ ID NO: 144 - DNA, 100 bp, Artificial
  Synthetic
gtggatgcgttccgccacgtcagtgatgcgtttgagcagaccagcgaaaccatcagccagcgcgccaataacgcgatcaacgatttggtgcgccagcgtc

SEQ ID NO: 145 - DNA, 100 bp, Artificial
  Synthetic
gttaagctggcgcaggcgttggccaatccgttatttccggcgctggacagcgccctgcgcgcgggccgtcatatcggtctcgacgagctggataatcacg

SEQ ID NO: 146 - DNA, 100 bp, Artificial; identical to SEQ ID NO: 55
  Synthetic

SEQ ID NO: 147 - DNA, 100 bp, Artificial
  Synthetic
tgatcaaatgtgcgctggtcgccgggatggtggtaattgcgttagtgaacaggtatgttctggtaccgcgcatgtcggcaagcggttcgcaggcggaaag

SEQ ID NO: 148 - DNA, 100 bp, Artificial
  Synthetic
gttaatgattgaacgcctgcgtgcgatcggctttaccgttgaaccgatggatttcggcgatacgcagaatttctgggcctggcgcggccacggcgagacg

SEQ ID NO: 149 - DNA, 100 bp, Artificial; identical to SEQ ID NO: 56
  Synthetic

SEQ ID NO: 150 - DNA, 100 bp, Artificial
  Synthetic
ccgtacccgctggtggacgatctggagcgattctacgaccatcttgagcagacgctgctggcgacgggctttatccgcccgaatcatccggggcaggtga

SEQ ID NO: 151 - DNA, 100 bp, Artificial
  Synthetic
atccgcaaaagcgaaaaagatacgcgtcagtatcaggcgatccgccttgataacgacatggtcgtgctgctggtttccgatccgcaggcggtgaaatcgc

SEQ ID NO: 152 - DNA, 100 bp, Artificial; identical to SEQ ID NO: 57
  Synthetic

SEQ ID NO: 153 - DNA, 100 bp, Artificial
  Synthetic
ccgccgttaatgccggtttatccggtggcgcgtggtgaaagccgcctgtatatgcaacgtatcgagaaggactggtattcgctgatgaacaccatccaga

SEQ ID NO: 154 - DNA, 100 bp, Artificial; identical to SEQ ID NO: 58
  Synthetic

SEQ ID NO: 155 - DNA, 100 bp, Artificial
  Synthetic
tctgaaggagaatggcaaagaggtggtgatcaaggttatccgcccggatattttgccgatcattaaagcggacatgaagctcatctaccgcctggcgcgc

SEQ ID NO: 156 - DNA, 100 bp, Artificial
  Synthetic
caggtgctggtaaaaagcaagtctattccggcagagcctgcccaggaattaggactcgatacctcgcgtccggtcatgtacgtcctgccctataattcga

SEQ ID NO: 157 - DNA, 100 bp, Artificial
  Synthetic
tcatcgtgatgcaggcccaggacgtctggatccgtaccctctatgaccgccaccgctttgtggtgcgcggcaaccttggctggatcgaagcggacaactt

SEQ ID NO: 158 - DNA, 100 bp, Artificial
  Synthetic
cgatagcgccgcgatgacctcaatgcttattggtatgggggttgcacaaagtggtcaggttgtgggtaaaatcggcgagacgtttggcgtaagcaacttg

SEQ ID NO: 159 - DNA, 100 bp, Artificial
  Synthetic
attcagttcgtgccgaagcagtacgaaaatatgtacttctcctggatgcgcgatattcaggactggtgtatctcccgtcagctgtggtggggtcaccgca

SEQ ID NO: 160 - DNA, 100 bp, Artificial; identical to SEQ ID NO: 59
  Synthetic

SEQ ID NO: 161 - DNA, 100 bp, Artificial
  Synthetic
cccgatgctgtgcggcgaagtggtcggcatgctggtgggcatcggcgtcggcacgctgctgggcatggagccgttccaggtgttcttctttatcgtgctg

SEQ ID NO: 162 - DNA, 100 bp, Artificial
  Synthetic
tcttcccaattttaaataacccggtgccagcaggtattgcctgtattgccatcgtgtggatctttactttcgttaatatgctcggcgggacctgggtcag

SEQ ID NO: 163 - DNA, 100 bp, Artificial
  Synthetic
cttctccgataccatcttcgtggtcggtacccgtctgctggtgaagaaaggcggtccgatcaaagatttcccggacctgaaggataaagcggtcgtcgtc

SEQ ID NO: 164 - DNA, 100 bp, Artificial
  Synthetic
tccggcagaaaatatcaacctgctgaatggtaacgcgccggacatcgatgcggaatgccgtcgctatgaagaaaaaattcgttcctacggtaaaatccac

SEQ ID NO: 165 - DNA, 100 bp, Artificial
  Synthetic
gacatcaaagatgtcaaagatctgaacggtaaagtggtcgcggtgaagagcggcaccggctccgttgactacgcgaaagccaatatcaaaaccaaagatc

SEQ ID NO: 166 - DNA, 100 bp, Artificial; identical to SEQ ID NO: 67
  Synthetic

SEQ ID NO: 167 - DNA, 100 bp, Artificial
  Synthetic
cttcagcaccgcagccacctacgcgttcgacaacggtatcgcactgtctgcaggctactccagctctaaccgtagcgtcgatcagaaagctgacggcaat

SEQ ID NO: 168 - DNA, 100 bp, Artificial
  Synthetic
agcggattggttttctgtgcgatatccgccaggcggtgttcaatccaaacctgtttccgcatgagaacatggaaggcaaaatcgaccgaccggaagagta

SEQ ID NO: 169 - DNA, 100 bp, Artificial
  Synthetic
ggaagccttacagattatggaagcggatgttataaatggcgctctggatagcgatgtcttcctcgttttgcgccaccatgcggaaacgctacacgccatc

SEQ ID NO: 170 - DNA, 100 bp, Artificial
  Synthetic
ctgtgcggcgtctacttcctcggcgaacagcgtatcgactatgagggcgccagcttcggggtggtcacctgcgatccgcagagtatcgatgttgaagcgg

SEQ ID NO: 171 - DNA, 100 bp, Artificial
  Synthetic
gaacaaaagcttagcaggaatactgggcgtcaccgtcgcgttaaccttactggcgggctgtaccgcttacgatcgtaccaaagaccagtttacccagccg

SEQ ID NO: 172 - DNA, 100 bp, Artificial
  Synthetic
agcggtgtacctgcaccaacggattggtggacgcatcaaagcctttttgccgatctatgatttttcctatgaaatgaccaccctgctgtcgccggacgag

SEQ ID NO: 173 - DNA, 100 bp, Artificial
  Synthetic
aggcagatcgtcaatatgctgacaaccggactcgccatccgtgacggtcgggtgtacagcaatttgcgggtggacgtgcaggctgacaattcgcactggg

SEQ ID NO: 174 - DNA, 100 bp, Artificial; identical to SEQ ID NO: 64
  Synthetic

SEQ ID NO: 175 - DNA, 100 bp, Artificial
  Synthetic
cgcgatgaatcgcacgatcatgcgatctccgggcatcgcaaaaaacgggcgaaagtgaagagcaccagctcgcttgagactatcgagggggtggggccga

SEQ ID NO: 176 - DNA, 100 bp, Artificial
  Synthetic
gtgccgggctaattccgcagatgtcgtcctgatggacatgaacatgcctgggatcggtggtcttgaagcgacgcgcaaaatcgcgcgctccgtggcgggc

SEQ ID NO: 177 - DNA, 100 bp, Artificial
  Synthetic
tcgcctgccgcacaagctgctgtgctacgtcaccttctccattttctgcattatggggacctatttcggtctgcatatcgaagactccatcgccaacacc

SEQ ID NO: 178 - DNA, 100 bp, Artificial
  Synthetic
gttaagcgaaaaagcccgcaatgtcgaatctgagccgtgccaaattaacccaaccttcactgacgttgacggcggtgtgcagctggatatcgattttgtt

SEQ ID NO: 179 - DNA, 100 bp, Artificial
  Synthetic
cgcgcggtaaatatgtcaccgtgctgaccaactggtgcggcgaattttcctcgcaggaagcgcgacgtttattcagcgatgccggcctccctacctaccg

SEQ ID NO: 180 - DNA, 100 bp, Artificial
  Synthetic
gtcgcagaccgtctcgccaaactggataagtggcaaactcatttaatcaacccgcacatcattctgtctaaggagccgcagggttttatcgctgatgcaa

SEQ ID NO: 181 - DNA, 100 bp, Artificial
  Synthetic
gcagctcaaaatactgtcgttcctgcagttctgcctttgggggagctggctcaccacgcttggctcgtacatgtttgtcacgctgaagtttgacggcgcg

SEQ ID NO: 182 - DNA, 100 bp, Artificial
  Synthetic
gatcccgacgccggtatggatcatggcgattgtcttcctggcggcctggtacatgctgcaccatactcgcctgggccgttatatttatgccctgggcggt

SEQ ID NO: 183 - DNA, 100 bp, Artificial
  Synthetic
tcattcggtctaccacacctacttcacgtcgattacgcaaaatgaagtggtgaagctcgatctccaccaggcgattgtcgatgccattcttaacagtgat

SEQ ID NO: 184 - DNA, 100 bp, Artificial
  Synthetic
attaacggcgacaaaggctacaacggcctcgctgaagtgggtaaaaagtttgaaaaagacaccggcattaaagtttccgtagaacacccggacaagctgg

SEQ ID NO: 185 - DNA, 100 bp, Artificial
  Synthetic
tcatgacgttcacatgatcgacttctactactgggatatctccggcccgggtgcaggtctggaaaacgttgaccttggcttcggtaagctctctctggcc

SEQ ID NO: 186 - DNA, 100 bp, Artificial
  Synthetic
cgctttgacgaacatttcgtccttgacctgctggtcgatgacgggcaggcccgcggcctggtggcgatgaatatgatggaaggcaccctggtgcagatcc

SEQ ID NO: 187 - DNA, 100 bp, Artificial
  Synthetic
gcgccctgcagggaacgccggaagccccgccgcccgccaccgaccatccgcaggagatccagcgctaccagacggctggcctgcagaaaatggccacggt

SEQ ID NO: 188 - DNA, 100 bp, Artificial
  Synthetic
ttttgccaacgccttcggcttcagcggctttaacgaaatgaaacagatgttcaagcaacatttgatggaagagaccgccaactataccgagcgcgcccgt

SEQ ID NO: 189 - DNA, 100 bp, Artificial
  Synthetic
cgcaaaaatgtcgatcgcggcattaatatgcatgtggtgacggaagtgcagcacattgtgatcctcgccgagcataagctgctggactatcgcgacgtcg

SEQ ID NO: 190 - DNA, 100 bp, Artificial
  Synthetic
tgaagattttcctgatggcgctggcgattattgatgacctcggggctatcgtgattatcgcgctgttttatacccacgacctgtccatgctctcgctggg

SEQ ID NO: 191 - DNA, 100 bp, Artificial
  Synthetic
tggagcagctgagccagcataagctcgacatgattatctctgactgcccgatcgactcgacgcagcaggaagggctattttcggtgaagatcggcgagtg

SEQ ID NO: 192 - DNA, 100 bp, Artificial
  Synthetic
gccgccgagcaggcggcgctggcccgtgccgatctggttatctggcagcatcctatgcagtggtatagcgtaccgccgctgctcaagctgtggatggaca

SEQ ID NO: 193 - DNA, 100 bp, Artificial
  Synthetic
aaagcgggcctggtcgcgccggacgaaaccaccttcaattacgtacgcggccgtctgcatgcgccgaaaggcaaagattttgacgatgccgtagcgtact

SEQ ID NO: 194 - DNA, 100 bp, Artificial
  Synthetic
gctgtggctgctggtcaagctggggattgtcttcgcggtgctgattgccgcctatggcgtctacctcgaccagaaaatccgcagccgcattgacggtaaa

SEQ ID NO: 195 - DNA, 100 bp, Artificial
  Synthetic
gcaacccgttcggtctgggcgaaaccgtgacctccgggattgtctccgcgctgggccgtagcggcctcaacgtggaaaactacgaaaactttatccagac

SEQ ID NO: 196 - DNA, 100 bp, Artificial
  Synthetic
atgctgggtttgaaacgggttcaccatattgccatcattgcgaccgactacgcccgcagtaaagcgttctattgcgatattctggggtttacgctgcaaa

SEQ ID NO: 197 - DNA, 100 bp, Artificial
  Synthetic
cattccgccgtttctggtccataccgcgctgaagatcacctcgccaaacggtaaaagctatagcgaccgtctggacaatgtgaagacggaaaagcagttg

SEQ ID NO: 198 - DNA, 100 bp, Artificial
  Synthetic
gcgtggtgctgggcaatatgctgaccaatatgttcagcggctcgcacccgcaggagatagtcaatatcatcgaagagaagccgcagcctgatgccgcctc

SEQ ID NO: 199 - DNA, 100 bp, Artificial
  Synthetic
cgcggcagttgggagccgctgctgtatggtctgcaccagatgcagatgcgtaataaaaagcgtcggcgcgagctgggaagcctgattaaacgctttcgca

SEQ ID NO: 200 - DNA, 100 bp, Artificial
  Synthetic
gtgctgaagccggaccacaccgccgggcagcgtcgtctgaccctcgcggggcagcaggggcagcagtttgcggtcgagaaagggctgcaggcgggcgagc

SEQ ID NO: 201 - DNA, 100 bp, Artificial; identical to SEQ ID NO: 69
  Synthetic

SEQ ID NO: 202 - DNA, 100 bp, Artificial
  Synthetic
ctgatgttcctgacctacaaaacggcgaataaacccaccgggattatttccgccttcgccttcaccgggttcctcggctatatccttgggccgatgctga

SEQ ID NO: 203 - DNA, 100 bp, Artificial; identical to SEQ ID NO: 61
  Synthetic

SEQ ID NO: 204 - DNA, 100 bp, Artificial
  Synthetic
gatcaaggcgtcggttgagccggatggccgccgtctggttgaggtccatcagccgctgtctgagcatatcgatgacgacccgcagaccctgcccattacg

SEQ ID NO: 205 - DNA, 100 bp, Artificial
  Synthetic
gctcaggactatgttgagaagcgaatcgacctcaacgagctgctggtgcagcatcccagcgcgacctattttgtcaaagccgctggcgacagcatgatcg

SEQ ID NO: 206 - DNA, 100 bp, Artificial
  Synthetic
cccgcgctgcgaaatttacagtatcgatgaggccttttgcgatgtcagcggtgtgcgtcattgcagagatctgaccgattttggccgcgaaatccgcgcc

SEQ ID NO: 207 - DNA, 100 bp, Artificial; identical to SEQ ID NO: 60
  Synthetic

SEQ ID NO: 208 - DNA, 100 bp, Artificial
  Synthetic
cgcgaacgccagcagcggctgaaagataaagttgacgcccgggtggcggcggcccaggacgagcgcggcattgtgatggtctttaccggcaacggcaaag

SEQ ID NO: 209 - DNA, 100 bp, Artificial
  Synthetic
tccggctgtgtctataacagtaaggtgtccaccggtgcggaacagctgcagcatcatcgcttcgtgctgaccagcgtcaacggccaggcggtcaacgcca

SEQ ID NO: 210 - DNA, 100 bp, Artificial
  Synthetic
caacgtatgtttaagaaagagaccggccattccctcggccagtacatccgcagccgcaagctgacggagattgcgcagaagctcaagcagagcaatgagc

SEQ ID NO: 211 - DNA, 100 bp, Artificial
  Synthetic
accagaaaaaagatcgcctgctcaatgactacctctcacctatggatattaccgcgacccagtttcgcgtgctctgctccattcgttgcgaagtatgtat

SEQ ID NO: 212 - DNA, 100 bp, Artificial
  Synthetic
cacgggcgcgctcccttgccgtgaactacggtctggtcggctatcaggcgctgccgccgggtatcgccaaaaatgtcgcccgcggcaaaccgctccctcc

SEQ ID NO: 213 - DNA, 100 bp, Artificial; identical to SEQ ID NO: 68
  Synthetic

SEQ ID NO: 214 - DNA, 100 bp, Artificial; identical to SEQ ID NO: 62
  Synthetic

SEQ ID NO: 215 - DNA, 100 bp, Artificial
  Synthetic
cggattattactaaacaaaaccacctttggccgtaatacgctggctattggcggcaatgaagaggcggcgcgcctggccggcgtcccggtggtgcgcacc

SEQ ID NO: 216 - DNA, 100 bp, Artificial; identical to SEQ ID NO: 63
  Synthetic

SEQ ID NO: 217 - DNA, 100 bp, Artificial
  Synthetic
gcagcgcttcaacgactggctggtcacctgtaacaaccaaaatttctgcgtcacccgtaacgtggggctgcatcatggcctggtgatgaccctcagccgc

SEQ ID NO: 218 - DNA, 100 bp, Artificial
  Synthetic
gcgctggggctgtgcctcggcggcagagcggaagccgacatggtgcgtcgcggcgccacccgtgccgacctgtgcgcgcgcttcgcgctgaaagataccc

SEQ ID NO: 219 - DNA, 71 bp, Artificial
  Synthetic
  misc_feature (71)..(71): n is a, c, g, or t
gccgcggcgataattatgtttatgtgaaccgcgaagcgcgcatggggcgaacagcgttagttattcatccn

SEQ ID NO: 220 - DNA, 100 bp, Artificial
  Synthetic
atgcaacagaccccacatcagcgcaagacgctcaccgaacgcgttatccacgccatcaccttcgaaggactggcgacgctgatcctcgcccctaccgccg

SEQ ID NO: 221 - DNA, 100 bp, Artificial; identical to SEQ ID NO: 65
  Synthetic

SEQ ID NO: 222 - DNA, 100 bp, Artificial
  Synthetic
ccgcgggccagttgctgaacatttattacgaaaccgccgataactggctgcgtcgtcacgatatggggctgcgcatccgcggcgatcaggggcgttatga

SEQ ID NO: 223 - DNA, 100 bp, Artificial
  Synthetic
catggcggcggaagaagaaattcagttttgcccactgagccagctgctgcccgctgactttagcgagctgccctcaggcaaagtggttcgtggtgaactg

SEQ ID NO: 224 - DNA, 100 bp, Artificial
  Synthetic
tgcgccaccctggggcggcaatatgaaattctgttgatcgacgatggcagcagcgacgattccgcgcgcatgctcaccgaagccgccgaggcggaaggca

SEQ ID NO: 225 - DNA, 100 bp, Artificial
  Synthetic
gaagtcattacgccgtcccagacctgggtctccactctcaatatgatctgcctgctgggcgccacgccggtgatgatcgatgtcgataacgacaatctga

SEQ ID NO: 226 - DNA, 100 bp, Artificial
  Synthetic
taagcggatcggcattgacccggcggtagtttccgcgccgtttatcgccacgctgattgatggcaccgggctaattatctatttcaaaatcgcccagtat

SEQ ID NO: 227 - DNA, 100 bp, Artificial
  Synthetic
gaccagccagttcctgctggcctgtaaatacgatgcgccagcgacgatcgcagccatgctggataacggcattgatgtggatggtcaggataaaaccggc

SEQ ID NO: 228 - DNA, 100 bp, Artificial; identical to SEQ ID NO: 66
  Synthetic

SEQ ID NO: 229 - DNA, 100 bp, Artificial
  Synthetic
tggcggcggtctataacgtcccgctggccggggcgttgttcagccttgaggtcatgctgctgtcgtttagctgggaaaaaacgctggcggcgataatgac

SEQ ID NO: 230 - DNA, 100 bp, Artificial
  Synthetic
ctcgactacctcgacgccttcggcgcggcgatccacgcggcgtttctgatggcggccggcattatggcggtggcgtttgtcctctcatggctgttaaagg

SEQ ID NO: 231 - DNA, 100 bp, Artificial
  Synthetic
gatgatggtcgagacgctggggcatatggcggagaaaaacgcctggttcgcgccgctgtggatgcaggagatcatcggcgagatgccgattctgcgccag

SEQ ID NO: 232 - DNA, 100 bp, Artificial
  Synthetic
accgtattctgcattttgctgttcgccgccctgctgcacgccagctggaacgctatcgtcaaagccagcggcgataaaatgtacgcggcgatcggcgtca

SEQ ID NO: 233 - DNA, 100 bp, Artificial
  Synthetic
cgctgggccgccacacggtgcagatgctgcatgacgtactggatgcgtttgcgcgtatggatctcgacgaagcggtacgtatctatcgcgaagataagaa

SEQ ID NO: 234 - DNA, 100 bp, Artificial
  Synthetic
ggtggcgcagatgcagcacttctcgggctgggcgggcgttatcgcgctggcgctgctgcaggtgcctatcgttattcgtaccaccgaaaacatgctgaag

SEQ ID NO: 235 - DNA, 100 bp, Artificial
  Synthetic
catgattttcagtgcgctggtaaaactggctgcgctgattgtgctattgatgctgggcggcatcatcgtttccctgatcatctcttcctggccgagcatt

SEQ ID NO: 236 - DNA, 100 bp, Artificial
  Synthetic
aataaagtgaactaccagggtattggttcctctggtggcgttaagcagattattgccaacaccgttgatttcggtgcttctgatgctccgctggctgatg

SEQ ID NO: 237 - DNA, 100 bp, Artificial
  Synthetic
cccggcggcaagagcgtggaggagtatcgcgcctattataagaagggctacgccaccgatgtggagcagattggcattgaagatgacgtgattgagttcc

SEQ ID NO: 238 - DNA, 100 bp, Artificial
  Synthetic
gcaattattgccgcaggatgcacgctcccatgcggtggtcattactcgtgaagatggcgtcttctgtggcaaacgctgggtggaagaggtctttattcag

SEQ ID NO: 239 - DNA, 100 bp, Artificial
  Synthetic
ccgacgatgggcaacctgcatgatggtcatatgaagctggttgatgaagccaaagccagtgcggacgtggtggtggtcagtattttcgtcaatccgatgc

SEQ ID NO: 240 - DNA, 100 bp, Artificial
  Synthetic
ctgcccgagcgcacccaggaaacgctggaacacgccctgctgaatatcatcgccacctttatcgaaaactgtcagcgcaaaattcgcgagctgatcgcta

SEQ ID NO: 241 - DNA, 100 bp, Artificial
  Synthetic
tggattatcaattaacgcttaactggcccgactttatcgaacgctactggcaaaaacggccggtggtattgaagcgcggcttcgccaattttatcgaccc

SEQ ID NO: 242 - DNA, 100 bp, Artificial
  Synthetic
tgttgccgccgtatgcggaacgtcaggagtcgcttccttattcagtcaggccgcttttgccgaagacgcgggcattgccgacgggcaaacgcgtcgtttt

SEQ ID NO: 243 - DNA, 100 bp, Artificial
  Synthetic
tcaatcagcggcaggcggcggtgctggtgccgatcgtgcgccggccgcagcccggcctgctgctgacccagcgttcgccgctgctgcgcaagcacgccgg

SEQ ID NO: 244 - DNA, 100 bp, Artificial
  Synthetic
gcgcgactgggactggagatcgccgggctcgacgccgaccatatctccctgcgctgtcatcagaataccactgcggaacgctggcgccgcggtctggagc

SEQ ID NO: 245 - DNA, 100 bp, Artificial
  Synthetic
agattgtatactgaaatcgaagcgggcgattttgctgctctggcgcaaaccgcccaccgcctcaaaggggcatttgctatgcttaatctgatacccggca

SEQ ID NO: 246 - DNA, 100 bp, Artificial
  Synthetic
gaacggcagatggacgaggcggcggtattcaccatccacggcttttgccaacggatgctgagccttaacgccttcgagtcgggcatgctgttcgagcaac

SEQ ID NO: 247 - DNA, 100 bp, Artificial
  Synthetic
tcggaccgctgcgccggattatcccggcaatggggccgattgacagcgcctcgctgctggtggcatttattctctgcgtcatcaaagcgatcgtgctgtt

SEQ ID NO: 248 - DNA, 100 bp, Artificial
  Synthetic
ggcgagctgatggggattaacaccctctcctttgacaagagcaatgacggcgaaacgccggaaggcattggctttgcgatcccgttccagttagcgacca

SEQ ID NO: 249 - DNA, 100 bp, Artificial
  Synthetic
gaatgaccgatgccgatttcggcaaaccgattatcgccgtcgttaactcctttacccagtttgtccccgggcacgtgcacctgcgcgatctcggcaaact

SEQ ID NO: 250 - DNA, 100 bp, Artificial
  Synthetic
tgatcccatttaacgcgccgccggtggttggaaccgagcttgattacatgcagtctgcgatgaacagcggcaagctgtgcggcgacggcggctttacgcg

SEQ ID NO: 251 - DNA, 100 bp, Artificial
  Synthetic
ctgcacagtttctgtttcggcgctatcttcaacatgatagtgctggcgcgcgaggggctggattcgttcggctcccgcgtggtgtttttcctcgtgatct

SEQ ID NO: 252 - DNA, 100 bp, Artificial
  Synthetic
cgacagcggggcgaaaatcgtcaccgtcgcgatggggtcgccgcgccaggagatctttatgcgcgactgccggcgcctgtatccgcacgcgctgtatatg

SEQ ID NO: 253 - DNA, 100 bp, Artificial
  Synthetic
gaagaggttgccgagatctatttgccgctgtcgcgtttgctcaacttctatatcagttctaacctgcgtcgccaggctgttctcgaacaatttcttggca

SEQ ID NO: 254 - DNA, 100 bp, Artificial
  Synthetic
caaaaaggccaatacctcttcgctggattactatcaccagctgcgccatgcggccagcagctcgcggcgtaagttcctctatgacactaacgttggcgcg

SEQ ID NO: 255 - DNA, 100 bp, Artificial
  Synthetic
ccttgggcgctatctgacccgcccgctgctgcgctttgtcgcccgttccggcctgcgcgaagtgttcagcgccgtggccctgttcctggtcttcggcttt

SEQ ID NO: 256 - DNA, 100 bp, Artificial
  Synthetic
tgggcaaccaggccgacacctatgtggaaatgaacctcgaacataaacagaccctggacaacggggcgaccacccgtttcaaagtgatggtggccgacgg

SEQ ID NO: 257 - DNA, 100 bp, Artificial
  Synthetic
gagatcgtcatgcgggtctattttgaaaaaccgcgcaccaccgtcggctggaaagggctcatcaacgatccccatatggataacagcttccgcatcaacg

SEQ ID NO: 258 - DNA, 100 bp, Artificial
  Synthetic
gagtggctggaaaccttccaggcgaaagagcaggaagcgacggagaaaatgctgtcgctggaacagaaaatgagcgtggcgcaaaccgcgcacagccagt

SEQ ID NO: 259 - DNA, 100 bp, Artificial
  Synthetic
gcgacggcttcagcaccgcagccacctacgcgttcgacaacggtatcgcactgtctgcaggctactccagctctaaccgtagcgtcgatcagaaagctga

SEQ ID NO: 260 - DNA, 100 bp, Artificial
  Synthetic
cctgctggtagccggtgcagccaacgctgcagaaatctataacaaaaacggcaacaaactggacttctatggaaaaatggtcggcgagcacgtctggacc

SEQ ID NO: 261 - DNA, 100 bp, Artificial
  Synthetic
ggagttccgcggtatccgtctgggcaccgtcggcaaagtgccgttctttattccggggctgaagcagcgtttgaacgatgactatcgtattccagtggaa

SEQ ID NO: 262 - DNA, 100 bp, Artificial
  Synthetic
ccgcgctgacctcgttcctgaccggtatcaccgagccgatcgagttctcgttcatgttcgtggcgccgatcctgtacgttatccatgccattctggcggg

SEQ ID NO: 263 - DNA, 100 bp, Artificial
  Synthetic
gctgcagtctatcggtgaactgatgatttccggcctcggcctggcgatggtcgctcagctggttcctcagcgtctgatgggcttcatcatgggcagctgg

SEQ ID NO: 264 - DNA, 100 bp, Artificial
  Synthetic
taccgtgaaatgctgattgctgacggtattgatccgaatgaactgctgagcaccatggctgccgttaaagccggtaccaaaaccaagcgtgctgcacgtc

SEQ ID NO: 265 - DNA, 100 bp, Artificial
  Synthetic
atcgcctatggattttcgaaattcatcatgggatcggtctctgaccgctcgaatccgcgcattttcctgccggctggcttgatcctcgccgcgctggtga

SEQ ID NO: 266 - DNA, 100 bp, Artificial
  Synthetic
tggtgctgctggcgagcctcgcgacctgtactttcgcctacccgtggcttgagggttacaaggacaacaaagaagagttctacctgctggtgctgatcgc

SEQ ID NO: 267 - DNA, 100 bp, Artificial
  Synthetic
gctggaggagatcgaacgccaggggctgttcctgcagcggatggatgattccggcgaatggttccgctatcacccgctgtttggcagcttcctgcgccag

SEQ ID NO: 268 - DNA, 100 bp, Artificial
  Synthetic
tccgttccccaaacgcggcggaagaacacctgaaagcgctggcgcgtaaaggcgcgatcgagatcgtctccggcgcttctcgcggtattcgcctgctgac

SEQ ID NO: 269 - DNA, 100 bp, Artificial
  Synthetic
cgcggagtacgccaccctcattattggcctgctgatggcgaagcgggtgctgacgctgcgcggcgtgtcgctggcgatgctgaaaaacgcctggcgcggg

SEQ ID NO: 270 - DNA, 100 bp, Artificial
  Synthetic
ctataaccgcgaaacgctggagattaagtacaagggtaagaccatccacgaagtgctggatatgaccattgaagaggcgcgtgaattctttgatgccgta

SEQ ID NO: 271 - DNA, 100 bp, Artificial
  Synthetic
cgaatcctggcgtgacaagcagaccggcgaaatgaaagagcagaccgagtggcaccgcgttgtgctgttcggcaaactggcggaagtcgctggtgagtat

SEQ ID NO: 272 - DNA, 100 bp, Artificial
  Synthetic
tgtcggtgctgcgccccgccagcgcccatgtcgccgaggcctttggcatcaatgagggcgagaacgtgatccacctgcgtaccctgcgccgggtcaatgg

SEQ ID NO: 273 - DNA, 100 bp, Artificial
  Synthetic
attgagatggcctggcaggaaaccttctgggcccacggcttcggcaaagtcgtcgaccgctttggcgtcccctggatgatcaacgtggtcaaacaaggct

SEQ ID NO: 274 - DNA, 100 bp, Artificial
  Synthetic
agcgacattctgatcgttaaagatgccaatggcaatttactggccgatggcgacagcgttaccgtcgtgaaagatctgaaggttaaaggcagctcttcga

SEQ ID NO: 275 - DNA, 100 bp, Artificial
  Synthetic
accgacaaaggttactacaccaacagcttccacctcgacgtggagaagaaggtcaacccgtacgacaagatcgatttcgaagcgccgtacccgccgctgg

SEQ ID NO: 276 - DNA, 100 bp, Artificial
  Synthetic
ccagcagtcgccgctcgattacgatcactatttaacaaagcagttgcagccggtggcggaagggatcctgcccttcgtcaacgatgactttgctacaata

SEQ ID NO: 277 - DNA, 100 bp, Artificial
  Synthetic
tgttgaagcgaaccggctccgtcaacatcagtcgaaagttaccaataatttccggtttattgctgtccagctgtattatcgcggcgaattgggtaagcgc

SEQ ID NO: 278 - DNA, 100 bp, Artificial
  Synthetic
agcgcttcggtaaattcgggcgtattctgtgggagcgcagccacgggattgatgagcgggaaattcataacgatcggcagcgtaaatcggtgggcgtgga

SEQ ID NO: 279 - DNA, 100 bp, Artificial
  Synthetic
cttggcgccctgtacgacgtggaagcctggaccgatatgttcccggaattcggcggcgattcctctgcccagaccgataactttatgaccaagcgcgcca

SEQ ID NO: 280 - DNA, 100 bp, Artificial
  Synthetic
tcaccaagcctttctctccgaaagagctggtggcgcgaatcaaagcggtgatgcgccgtatttcaccgatggcggtggaagaggtgatcgaaatgcaggg

SEQ ID NO: 281 - DNA, 100 bp, Artificial
  Synthetic
gagcacggcgagcgcgtgcgctatctgcactcggatatcgacaccgtcgagcgcatggaaatcatccgcgacctgcgtcttggcgagtttgacgtgctgg

SEQ ID NO: 282 - DNA, 100 bp, Artificial
  Synthetic
gcaaggcgcaaccactttagatggtctggaagcaaaactggctgctaaagccgaagccgctggcgcgaccggctacagcattacttccgctaacaccaac

SEQ ID NO: 283 - DNA, 100 bp, Artificial
  Synthetic
cagctggcgcagaaagcggatgagatgggcgccacttcataccgtattacttcggtaaccggtccgaatacccttcacggtaccgccgttatctacaagt

SEQ ID NO: 284 - DNA, 100 bp, Artificial
  Synthetic
ccaaacgcatgcagcgcattttcccggaggcggaagtgcgggtgaagccgatgatgacgctgccggcgatcaacaccgacgccagcaagcatgaaaaaga

SEQ ID NO: 285 - DNA, 100 bp, Artificial
  Synthetic
agtgcggctttcccagcccggctcaggactatgttgagaagcgaatcgacctcaacgagctgctggtgcagcatcccagcgcgacctattttgtcaaagc

SEQ ID NO: 286 - DNA, 100 bp, Artificial
  Synthetic
gcgctgcgaaatttacagtatcgatgaggccttttgcgatgtcagcggtgtgcgtcattgcagagatctgaccgattttggccgcgaaatccgcgccacg

SEQ ID NO: 287 - DNA, 100 bp, Artificial
  Synthetic
tgctggaggcgcggttgattaaagagcagcagccgctgtttaacaagcggctacggcgtaacaagcagctctgcgcctggctacttgcggacgaccggcc

SEQ ID NO: 288 - DNA, 100 bp, Artificial
  Synthetic
agcccgtggcgcgggcctttggccaccgcggcttcacccacagcctgctggccgtctttggcgcgctgacgctgttctatctgaaagtgcctgacagctg

SEQ ID NO: 289 - DNA, 100 bp, Artificial
  Synthetic
accgtctccctcgacgattttgaccagaccgagctggtgatctccatcggccataatccgggcaccaaccacccgcggatgatgggcaccctgcatgagc

SEQ ID NO: 290 - DNA, 100 bp, Artificial
  Synthetic
tgcgctctatcgccaccgtttcgatttccggcaccctgcctgagaagctgcacgctattgcggcggcggggtatcagggggtggaaattttcgagaacga

SEQ ID NO: 291 - DNA, 100 bp, Artificial
  Synthetic
tgatcggcgttgatattgtgctggcggtcatctcctcgattattatcgccatgataatgacctcgaccggcctgccggaaatgggcacgatgctggcgaa

SEQ ID NO: 292 - DNA, 100 bp, Artificial
  Synthetic
gcggttgaaattaaatatgtggtgatccgcgaaggtgaggaaaaaatgtcttttgccagcaaaaaagaggccgacgcttacgacaaaatgctcgatctgg

SEQ ID NO: 293 - DNA, 100 bp, Artificial
  Synthetic
tcgttaatcaactgcagggaatgtcggtaaaagttggcgccggggaaactcaggcgcattggcggttggcggatgccgccgctgtaaggacgtggttgca

SEQ ID NO: 294 - DNA, 100 bp, Artificial
  Synthetic
aacaacgacggttatctgcagctggtgggtatcatgcagaagtttatcgaccagtcgatctctgccaacactaactacgatccgacgcgcttcccgtccg

SEQ ID NO: 295 - DNA, 100 bp, Artificial
  Synthetic
gctgaacctgctgcgctccggcagcgacgatccggaaatggcggaaatcgccgaagagtgcaagcaggagtgctatgacctgttcgtgctggcggcgcag

SEQ ID NO: 296 - DNA, 100 bp, Artificial
  Synthetic
cgttttgtgaaagtcaacaccgaagcggaacgtgagcttagcgcccggtttcgtatccgcagcatcccgaccattatgatgttcaaaaatggcgaagtga

SEQ ID NO: 297 - DNA, 100 bp, Artificial; identical to SEQ ID NO: 218
  Synthetic

SEQ ID NO: 298 - DNA, 100 bp, Artificial
  Synthetic
ccactctggaacgagtggtttaccgtcctgacatcaaccagggtaactatctggcaccaaacgatgtagcaaaaattcgtgtcggtatgacgcaacagca

SEQ ID NO: 299 - DNA, 100 bp, Artificial
  Synthetic
acagcgtaaatacggcgaaccgttaccttccgcctttactgaaaaagtgaaagttcagcgattcctgctttaccgcggctacctgatggaagatatccag

SEQ ID NO: 300 - DNA, 100 bp, Artificial
  Synthetic
cgggtaacctgaagcagtccaacacgctgctgatctttatcaaccagatccgtatgaaaattggcgtgatgttcggtaacccggaaaccactaccggtgg

SEQ ID NO: 301 - DNA, 100 bp, Artificial
  Synthetic
tgctgcaggcggcggaagcgctcaattaccggccaaacatgatagcccagtcgttgctcagccagtccaccggctgcatcggcgtcatctgcgcccagga

SEQ ID NO: 302 - DNA, 100 bp, Artificial
  Synthetic
aaagccttgaacagcatttcaatatgctgcgccgcctggcggaaaactggcagagcggcaaaaaccgctttaacgcgccgggcgaaacgctgctgggcgc

SEQ ID NO: 303 - DNA, 100 bp, Artificial; identical to SEQ ID NO: 232
  Synthetic

SEQ ID NO: 304 - DNA, 100 bp, Artificial; identical to SEQ ID NO: 236
  Synthetic

SEQ ID NO: 305 - DNA, 100 bp, Artificial
  Synthetic
ttgccataagctgtgttatttctgcggctgcaataagatagtcacccgccagcagcataaggccgatcaatatctcgatgtccttgaacaggagatcatc

SEQ ID NO: 306 - DNA, 100 bp, Artificial
  Synthetic
cggaactcgccgactatttagaactcgaaaaccatatgccgcgcgcctttaccgaagcgcaggctgaagctatggtcaccatcgtttttagcgctggcgc

SEQ ID NO: 307 - DNA, 100 bp, Artificial
  Synthetic
aagatgtgccggtggaattcccggagggcctggggctggtgactatctgcgagcgcgacgatccgcgcgacgcgtttgtctccaatcgctatgcctcgat

SEQ ID NO: 308 - DNA, 100 bp, Artificial
  Synthetic
aacgttgagtatgttcaggccaacgcggaagccctgccttttgctgataatacctttgactgcatcaccatctctttcggtctgcgtaacgtgaccgaca

SEQ ID NO: 309 - DNA, 100 bp, Artificial
  Synthetic
agggtaaacgtctggtggcgctggatatcaagcagaccggcgtattgcagggactaccgctgcagtttagcggcagcaacctggtgaagagtattcgcgc

SEQ ID NO: 310 - DNA, 100 bp, Artificial
  Synthetic
ggggctcggacatcaacttcatcgtgatgcaggcccaggacgtctggatccgtaccctctatgaccgccaccgctttgtggtgcgcggcaaccttggctg

SEQ ID NO: 311 - DNA, 100 bp, Artificial
  Synthetic
tacaggcagatgaccgacaaaactgctatattgaagtgaaatcggttacgttggcggagaaagaatacggttattttcccgatgcggtgaccacgcgcgg

SEQ ID NO: 312 - DNA, 100 bp, Artificial
  Synthetic
gcacattgccaaacaagatctggaaacgggtggtgtacaggttctgtcatcaacgtttttagacgaaacgccaagtctggcacctaacggcactatggta

SEQ ID NO: 313 - DNA, 100 bp, Artificial
  Synthetic
ctgtggtatggcgagaaaatccatgtcgccgtggcggccgaagtgcccggcaccggcgtggataccccggaagatctggagcgcgtccgcgctgagctgc

SEQ ID NO: 314 - DNA, 100 bp, Artificial
  Synthetic
agatcacccagaatctggccggcggcaccgacaacaccctggcctcggtactcgactgtacggtgacgccgatgggtagccggatgctcaagcgctggct

SEQ ID NO: 315 - DNA, 100 bp, Artificial
  Synthetic
cgagggctgccaggtactggaatatgctcgccataagcgtaagctgcgtttaggcgcgctgaaaggcaaccagtttaccgtgatcctgcgcgagattagc

SEQ ID NO: 316 - DNA, 100 bp, Artificial
  Synthetic
tcgttgatggataacttcatcatggacgtgcagggcagcggctatatcgactttggcgatggttcgccgctcaacttctttagctatgccgggaaaaacg

SEQ ID NO: 317 - DNA, 100 bp, Artificial
  Synthetic
gtcatggacggtcatgcgcttctcggaggtggaacaaaacgacaagctggaatggctcatccgcaaggatggctgcatgcactgcgcggacccgggctgc

SEQ ID NO: 318 - DNA, 100 bp, Artificial
  Synthetic
cgacgtggtgttggtagaagagggagccacattcgctatcggtttgccgccagaacgttgccatttattccgtgaggatggcaccgcttgtcgtcggctg

SEQ ID NO: 319 - DNA, 100 bp, Artificial
  Synthetic
atgttaaacaacattcgtatcgaagaagatctgttgggcaccagggaagttcccgcggacgcttactacggcgttcatactctgcgagcgattgaaaact

SEQ ID NO: 320 - DNA, 100 bp, Artificial
  Synthetic
gagcgtctgccgtttatctgtgaactggcgaaagcctacgtcggcgtcgatccggtgaaagagccgatcccggtgcgcccgaccgcgcactacaccatgg

SEQ ID NO: 321 - DNA, 100 bp, Artificial
  Synthetic
gaacattttaacgataaagccgccgtggtggctcgcctgcgcgagctgctggcggagcacaaaataatgaccattttagtgaagggttcacgtagtgccg

SEQ ID NO: 322 - DNA, 100 bp, Artificial
  Synthetic
catatctgacgtttcgcgccatcgtcagcctgctgaccgcgctgttcatctcgttgtggatgggcccgcgcatgatcgcccgtctgcaaaaactcgcctt

SEQ ID NO: 323 - DNA, 100 bp, Artificial
  Synthetic
gcaggcggtggcggcaaccatcctcaacgtgactgaggaccatatggaccgctacccgctggggctgcagcagtatcgcgcggcgaagctgcggatttac

SEQ ID NO: 324 - DNA, 100 bp, Artificial
  Synthetic
ctggcctgctggctgggggtgatggggttcgtggtttatgtcggcgtctacagcctgtacatgaaacgccactccgtctacggcacgctgattggctcac

SEQ ID NO: 325 - DNA, 100 bp, Artificial
  Synthetic
catgcggttatccttggcaccattctggtgaccgctgtggtgcagatcgtggtacacctcgtgtacttcctgcatatgaacagcaagtccgatgaaggtt

SEQ ID NO: 326 - DNA, 100 bp, Artificial
  Synthetic
cggtgctgatgttccaggtttcacgtcgtggcctgaccagcactaaccgcacgcgtatcctgtgcctgagcctgttctggcacttcctggacgtcgtgtg

SEQ ID NO: 327 - DNA, 100 bp, Artificial
  Synthetic
ggtatcgtctacatcgccgcgactcaggttatcgccggtatgtatcctgcttctcagatggccgcgtccggtgcgccgttcgcaattagcgcctctacca

SEQ ID NO: 328 - DNA, 100 bp, Artificial
  Synthetic
gatatctccatttcggtttctgaactgggttccctgctggaccacagcggcccgcacaaagaagcggaagagtatatcgctcgcgtgtttaacgcagaac

SEQ ID NO: 329 - DNA, 100 bp, Artificial
  Synthetic
ttctatgtggcgatgattctggtgctggcctcgctgttcttccgtccggtcggttttgactaccgttccaagatcgaggacacccgctggcgcaacatgt

SEQ ID NO: 330 - DNA, 100 bp, Artificial
  Synthetic
attcagtggacctacttcggttacctggctgccgtgaaatctcagaacggcgcggcaatgtccttcggtcgtacctccagcttcctggatatctacatcg

SEQ ID NO: 331 - DNA, 100 bp, Artificial
  Synthetic
atacttttgtggaggccgtgagcctgggtatcctcgctaacctgatggtttgtctcgccgtatggatgagctattccggtcgtagcctgatggataaagc

SEQ ID NO: 332 - DNA, 100 bp, Artificial
  Synthetic
ttctcagggtggtatcggtgacctgtacaacttcaaactcgcgccttccctgactctgggttgtggttcctggggtggtaactccatctctgaaaacgtt

SEQ ID NO: 333 - DNA, 100 bp, Artificial
  Synthetic
tccaccttccagatgatctccgtgatcttccgtaagctgactatggaccgcgtgaaggcccagggcggcagcgaagcgcaggcgatgcgcgaggcggcga

SEQ ID NO: 334 - DNA, 100 bp, Artificial
  Synthetic
taatattgcgaaagaacgcctgcaaatcatcgtcgccgagcgccgccgcggagacgcggagccgcattacctgccgcagttacgcaaagatatcctggaa

SEQ ID NO: 335 - DNA, 100 bp, Artificial
  Synthetic
cgtatcgtcgagggcggcgtgaaaatcaccagcgtcaacatcggcggtatggcgttccgccagggtaaaacccaggttaacaacgcgatttcagtcgatg

SEQ ID NO: 336 - DNA, 100 bp, Artificial
  Synthetic
atacaccactttttcacagacgaaaaacgatcagctgctggaacccatgttttttggccagccggttaacgtggcccgctacgatcagcaaaaatacgac

SEQ ID NO: 337 - DNA, 100 bp, Artificial
  Synthetic
tgctaccgctgctgatcgtcggcttgacggtggtggttgtgatgctctccattgcgtggcgacgcaatcattttctcaatgccacgctgtcggttcttgg

SEQ ID NO: 338 - DNA, 100 bp, Artificial
  Synthetic
cgtgaaatcgaaaaataccagggcttcttccacctcaacctgatgtggatcctgggcggcgttatcggcgtgttcctcgccatcgacatgttcctgttct

SEQ ID NO: 339 - DNA, 100 bp, Artificial
  Synthetic
tccatcgccaacagtgcgcctggccgcttcttcggtacctggtggttccatgcctggggcttcgactggttatacgacaaggtgttcgtaaaaccattcc

SEQ ID NO: 340 - DNA, 100 bp, Artificial
  Synthetic
ggttatcgtttacgccatcctgggcattaacgaccagggtatcgacggtgcggcgattaacgccaaagaagtgggcattgcgctgtttgggccgtacgtc

SEQ ID NO: 341 - DNA, 100 bp, Artificial
  Synthetic
taaaagaattattggtggggttcggcacccaggtccgtagtatctggatgattggcctgcatgccttcgccaaacgtgaaacccggatgtatccggaaga

SEQ ID NO: 342 - DNA, 100 bp, Artificial
  Synthetic
ttaaagaggactggatcccgcgcttctccgatcgcgtgatctttactctggcgccggttatcgcctttacctcgctgctgctggccttcgctatcgtgcc

SEQ ID NO: 343 - DNA, 100 bp, Artificial
  Synthetic
catagcttccgccgctatcgtttcaccaagcgtacccaccgcaatcaggatctggggccgtttatttcgcacgaaatgaaccgctgcatcgcctgctacc

SEQ ID NO: 344 - DNA, 100 bp, Artificial
  Synthetic
ccaacggcgtcgagtggtaccagaacatttccaccagcaaagatgctggcaccaagctgatgggcttctccggccgggtgaagaatccgggcgtctggga

SEQ ID NO: 345 - DNA, 100 bp, Artificial
  Synthetic
accctgctgccgacctgctgcctgggtaactgcgacaagggaccgaccatgatgattgatgaggatactcacagccatctgacgccggaggcaattcctg

SEQ ID NO: 346 - DNA, 100 bp, Artificial
  Synthetic
ccgaccatcctgcgcgactctcaggaatatgtttccaagaaacacaacctgccgcacaacagcctgaacttcgtgttccacggcggttccggttcttccg

SEQ ID NO: 347 - DNA, 100 bp, Artificial
  Synthetic
atgacaccaacgcccgccactttgccggccttaatttcaccgaaaagaaactgcaggaagccgtcagctttgtgcatcagcaccgtcgtaagctgcatat

SEQ ID NO: 348 - DNA, 100 bp, Artificial
  Synthetic
atctgatcaataatccggtgatccatgacgcgatgcgctttttcctgcgccatcagccggagaatatgaccctggtggtcctgtcgcgtaacctgccgca

SEQ ID NO: 349 - DNA, 100 bp, Artificial
  Synthetic
cgaaaaaatccaggtaacgggtagcgaaggtgaactgggtatttacccgggccacgcgccgctgctcaccgccattaagcctggtatgattcgcatcgtt

SEQ ID NO: 350 - DNA, 100 bp, Artificial
  Synthetic
ctgaccatggctgagaaattccgtgacgaaggtcgtgacgtactgctgttcgtcgataacatctatcgttacaccctggccggtactgaagtatccgcgc

SEQ ID NO: 351 - DNA, 100 bp, Artificial
  Synthetic
taacccatccctgtccgaactgatcggcccggtaaaagtgatgttgcaggcctatgatgaaggccgtctggacaagctgtacgttgtcagcaacaaattt

SEQ ID NO: 352 - DNA, 100 bp, Artificial
  Synthetic
atgtcccatcaggatattattcaaactttgattgaatggattgatgaacatatcgatcaaccacttaacattgatatagtcgccagaaagtcaggatact

SEQ ID NO: 353 - DNA, 100 bp, Artificial
  Synthetic
cgctggaacccggccgatctcgggcgctttatggtcttctttggaccgatcagctcgattttcgatatcctcaccttcggcctgatgtggtgggtgttcc

SEQ ID NO: 354 - DNA, 100 bp, Artificial
  Synthetic
tggcgctgttaggtagccgggtcccgacggcgctgaagattttcctgatggcgctggcgattattgatgacctcggggctatcgtgattatcgcgctgtt

SEQ ID NO: 355 - DNA, 100 bp, Artificial; identical to SEQ ID NO: 191
  Synthetic

SEQ ID NO: 356 - DNA, 100 bp, Artificial
  Synthetic
taggcaccatctctgcttctgccgggactaacctgggctcgctggaagaccagctggcgcagaaagcggatgagatgggcgccacttcataccgtattac

SEQ ID NO: 357 - DNA, 100 bp, Artificial
  Synthetic
ccggttactctaagtggcacctgcaacgtatgtttaagaaagagaccggccattccctcggccagtacatccgcagccgcaagctgacggagattgcgca

SEQ ID NO: 358 - DNA, 100 bp, Artificial; identical to SEQ ID NO: 211
  Synthetic

SEQ ID NO: 359 - DNA, 100 bp, Artificial
  Synthetic
gaggcggcgcagcgcattcatgccttgccgggggccggtgacgaagagaaacgctatgtcttacgcgtcacctgtctgcgcgaacatgaaaatgccgtac

SEQ ID NO: 360 - DNA, 100 bp, Artificial
  Synthetic
atgatgcgaatcgcgcttttcctgctgacgaacctggcagtgatggtcgtgttcgggctggtgttaagcctcacggggatccaatccagcagcatgaccg

SEQ ID NO: 361 - DNA, 100 bp, Artificial
  Synthetic
gctgatattatcaacagcgagcaggcccagggccgcgaggccatcggcacggtttccgtcggcgcggtagcatcttccccgatggatatgcatgaaatgc

SEQ ID NO: 362 - DNA, 100 bp, Artificial
  Synthetic
cttaagcggatcggcattgacccggcggtagtttccgcgccgtttatcgccacgctgattgatggcaccgggctaattatctatttcaaaatcgcccagt

SEQ ID NO: 363 - DNA, 100 bp, Artificial
  Synthetic
agcggctcacgtggcgtgaaggaagccagtcgtcaggcggtgctgcaggcggcggaagcgctcaattaccggccaaacatgatagcccagtcgttgctca

SEQ ID NO: 364 - DNA, 100 bp, Artificial
  Synthetic
atatgctgcgccgcctggcggaaaactggcagagcggcaaaaaccgctttaacgcgccgggcgaaacgctgctgggcgccttcgtcaaccaccagctggt

SEQ ID NO: 365 - DNA, 100 bp, Artificial
  Synthetic
tattcaactggaaggcacccgtctggtggtgaaaggcacgccgcagcagccggaaaaagagaccacatggctgcaccaggggttggtgagccaggccttc

SEQ ID NO: 366 - DNA, 100 bp, Artificial
  Synthetic
cagagcaacggcggctaccctccgtataacgtcgagctggtagacgaaaaccactatcgcatcgctatcgcggtggctggctttgctgaaagcgagctgg

SEQ ID NO: 367 - DNA, 100 bp, Artificial
  Synthetic
atgagtgtgattgcgcaggcaggggcgaaaggtcgtcagctgcataaatttggtggcagtagtctggctgatgtgaagtgttatttgcgtgtcgcgggca

SEQ ID NO: 368 - DNA, 100 bp, Artificial
  Synthetic
tctggaagaagcagtttccactgcgctggagttggcctcaggcaaatcggacggtgcggaagttgccgtcagcaagaccaccggcattagcgtaagcacg

SEQ ID NO: 369 - DNA, 100 bp, Artificial
  Synthetic
ttggctcgctttgtagaactttatccggttttacagcagcaggcgcaaaccgatggcaaacggattagctacgttgatttgcgttatgactctggagcgg

SEQ ID NO: 370 - DNA, 100 bp, Artificial
  Synthetic
gatatcggtggtggtacaatggatatcgccgtttataccggtggggcattgcgccacactaaggtaattccttatgctggcaatgtcgtgaccagtgata

SEQ ID NO: 371 - DNA, 100 bp, Artificial
  Synthetic
gtcagccacgggctgatgatgagtgaagccgagcaattgaataaaggctttctcaagcggatgcgcaccggctttccttatattcagttaaaacttggcg

SEQ ID NO: 372 - DNA, 100 bp, Artificial
  Synthetic
aacgttgaatgaactgagcgaagaagctctgattcagatcctcaaagagccgaaaaacgccctgaccaagcagtatcaggcgctgtttaatctggaaggc

SEQ ID NO: 373 - DNA, 100 bp, Artificial
  Synthetic
aggacggtctgtcactgattcgccgctggcgtagcaatgatgtttcactgccgattctggtattaaccgcccgtgaaagctggcaggacaaagtcgaagt

SEQ ID NO: 374 - DNA, 100 bp, Artificial
  Synthetic
aacggaaaactgcgcatcggctatgtaccgcagaagctgtatctcgacaccacgttgccactgaccgtaaaccgttttttacgcttacgccctggtacac

SEQ ID NO: 375 - DNA, 100 bp, Artificial
  Synthetic
gaacaggcccgacgggtgctggataccactatgcaaatgtacgaacagtggcgggaacagcaaccgaagctggcgcatccgcaactggaggcgctactgc

SEQ ID NO: 376 - DNA, 100 bp, Artificial
  Synthetic
agggcagcggtctgggattaagcattgccagggattgtattcgccgtatgcaaggggaactgtatctggtcgacgagagcgggcaagacgtttgtttccg

SEQ ID NO: 377 - DNA, 100 bp, Artificial
  Synthetic
gagagcgtcggtaagtcggtcgttaaccttattcacggcgtgcgtgatatggcggcgatccgccagctgaaagcgacgcacactgattctgtttcctccg

SEQ ID NO: 378 - DNA, 100 bp, Artificial
  Synthetic
atgcatacgggcgatgagatcccgcatgttaagaaaacggccagtctgcgtgacgcattgctggaagttacccgcaaaaatcttggtatgactgtcattt

SEQ ID NO: 379 - DNA, 100 bp, Artificial
  Synthetic
cgttgtgcgctcacctctgatattgaagtcgctatcattaccgggcgaaaggctaaactggtagaagatcgttgtgccacattggggatcactcacttgt

SEQ ID NO: 380 - DNA, 100 bp, Artificial
  Synthetic
acaaagcgacggcattgactgaagcagttaatcgccagctgcaccctaaaccggaagatgaatctcgcgtcagtgcctcattacgttcagcaattcaaaa

SEQ ID NO: 381 - DNA, 100 bp, Artificial
  Synthetic
gtcagcaagtgctcactatcatgagcgagcgcctgccgattgaacgtattcaactccgtccgcactgtagcattggcgtggcgatgttctacggcgatct

SEQ ID NO: 382 - DNA, 100 bp, Artificial
  Synthetic
tctgcaggatggcgctatcagcgcttatgatctgcttgatttgctgcgcgaagctgaaccgcaagccaagccgccaacggtttatcgcgcgctggatttt

SEQ ID NO: 383 - DNA, 100 bp, Artificial
  Synthetic
tgcgcaataccagttcgatttcggtctgcgtccgtccatcgcttacaccaaatctaaagcgaaagacgtagaaggtatcggtgatgttgatctggtgaac

SEQ ID NO: 384 - DNA, 100 bp, Artificial
  Synthetic
atgaaagctactaaactggtactgggcgcggtaatcctgggttctactctgctggcaggttgctccagcaacgctaaaatcgatcagctgtcttctgacg

SEQ ID NO: 385 - DNA, 100 bp, Artificial
  Synthetic
aagatgcagttaagcatccggaaaaatatccgcagctgaccatccgtgtatccggttatgcagttcgctttaactctctgactccggaacagcagcgcga

SEQ ID NO: 386 - DNA, 100 bp, Artificial
  Synthetic
cagctgcaaaaacaccagggaaataccattgaaattcgttacaccacgcatgaacaattcaaacaacaaaccgcagaaagtcaggcggtaattcgcagcg

SEQ ID NO: 387 - DNA, 100 bp, Artificial
  Synthetic
aagtttaaccgaacatcagcgtcagcagatgcgagatcttatgcaacaggcccggcacgaacagcctcctgttaatgttagcgaactggagacaatgcat

SEQ ID NO: 388 - DNA, 100 bp, Artificial
  Synthetic
atcgatcgccttagcagcctgaaaccgaagtttgtatcggtgacctatggcgcgaactccggcgagcgcgaccgtacgcacagcattattaaaggcatta

SEQ ID NO: 389 - DNA, 100 bp, Artificial
  Synthetic
tgggacagtctgttcggcacgccaggcgtacagctgacggacgatgatattcaaaatatgccctacgccagccagtacatgcagcttaatggcgggccgc

SEQ ID NO: 390 - DNA, 100 bp, Artificial
  Synthetic
ggacgcacgcaaaaagcgccggtggcttactggaacaagcgtcacgtagagccgatgcccggcagcattatttatgttggcctcgcggactccgtctgga

SEQ ID NO: 391 - DNA, 100 bp, Artificial
  Synthetic
caactacgacaagtttaactacaccaatccgccgcaggactcgcacttaccgcgcgtgcgtacccatgtgcgcgagtatgtgcagaacgatgtctatgtg

SEQ ID NO: 392 - DNA, 100 bp, Artificial
  Synthetic
atacctgcgacccgcgtcaggtgcccgatgcgaggttgttgaagtcgatgtcctaccaggaagcgatggagctttcctacttcggcgctaaagttcttca

SEQ ID NO: 393 - DNA, 100 bp, Artificial
  Synthetic
gcaggcggcaccgggcatgtggtggagttttgcggcgaagcaatccgtgatttaagcatggaaggtcgtatgaccctgtgcaatatggcaatcgaaatgg

SEQ ID NO: 394 - DNA, 100 bp, Artificial
  Synthetic
atcacagtttgacgttctgctgtgctccaacctgtttggcgacattctgtctgacgagtgcgcaatgatcactggctcgatggggatgttgccttccgcc

SEQ ID NO: 395 - DNA, 100 bp, Artificial
  Synthetic
cacaccgccattaatcaccaggagatatggcgcaccagccagttagttagccagatttgtaatatgccgatcccggcaaacaaagccattgttggcagcg

SEQ ID NO: 396 - DNA, 100 bp, Artificial
  Synthetic
ttaacgtagaaggtagcacaaccgttaatacgccgcgtatgccgcgtaatttccagcagttcttcggtgatgattctccgttctgccaggaaggttctcc

SEQ ID NO: 397 - DNA, 100 bp, Artificial
  Synthetic
cctttacgacggttctccccaggactgaaagcccagtttgccttcggcatggtctttttgttcgttcagcccgatgccagcgctgctgacataagtgcgc

SEQ ID NO: 398 - DNA, 100 bp, Artificial
  Synthetic
acgccactcggtagcctggcgttccagtatgccgaaggcattaaaggttttaactcacagaaaggtctatttgacgtggctatcgagggtgactcaacgg

SEQ ID NO: 399 - DNA, 100 bp, Artificial
  Synthetic
ccgtgataatgagtggttatccgcggtaaaggggaaacaggtcgtattgattgcggccagaaagtcagaagccttagcaaattattggtattacaacagc

SEQ ID NO: 400 - DNA, 100 bp, Artificial
  Synthetic
ggaaacaggtcgcccacgggtggaaattggtttaggtgtcggcaccattttcgggctgatcccgtttttagtaggctgcctcatttttgcagtggtggcg

SEQ ID NO: 401 - DNA, 100 bp, Artificial
  Synthetic
aaatggtctgcttcgtgctcgaacaaaatggctttcagccggtcgaagcggaagattatgacagtgctgtgaatcaactgaatgaaccctggccggattt

SEQ ID NO: 402 - DNA, 100 bp, Artificial
  Synthetic
tggaaattcgcgtcatgccttatacccacaaacagttgctgatggtggcgcgtgatgtcacgcaaatgcatcaactggaaggggcgcggcgtaacttttt

SEQ ID NO: 403 - DNA, 100 bp, Artificial
  Synthetic
gacggcagcagtggcgaagtgagtctggtgggacaaccgctacataatatggacgaagaagcgcgggcaaagttgcgcgcgaagcacgtcggctttgttt

SEQ ID NO: 404 - DNA, 100 bp, Artificial
  Synthetic
agcgatacttacacgactacgcaacagcgttgtaaaacggtgtatgacaagtcagaaaaaatgctcggttatgatgtgacctataagattggcgatcagc

SEQ ID NO: 405 - DNA, 100 bp, Artificial
  Synthetic
tactgctgagtgtggcggttaatttcgttcccacgccgtggtggggaatgaacagtgtgatccgcaatttgccttattacagccttggcgcatggtttgg

SEQ ID NO: 406 - DNA, 100 bp, Artificial
  Synthetic
ccaacgaaatggcaaaaactgacagcgcacaggttgcagaaattgttgcggtaatgggtaatgccagcgttgccagccgtgatttaaaaattgagcaatc

SEQ ID NO: 407 - DNA, 100 bp, Artificial
  Synthetic
aggcgttggtttacttactggcaatggtgttaatggcgtactgaaaggtgcagctgttggcgctggtgttggtgcagtaacagaaaaaggccgcgacggt

SEQ ID NO: 408 - DNA, 100 bp, Artificial
  Synthetic
ctcatggcagggcacaaaggacatgaatttgtgtgggtaaagaatgtggatcatcagctgcgtcatgaagcggacagcgatgaattgcgtgctgtggcgg

SEQ ID NO: 409 - DNA, 100 bp, Artificial
  Synthetic
ggttaatcagaagaaagatcgtctgcttaacgagtatctgtctccgctggatattaccgcggcacagtttaaggtgctctgctctatccgctgcgcggcg

SEQ ID NO: 410 - DNA, 100 bp, Artificial
  Synthetic
accttcgataaagcaaaagctgaagcgcagatcgcaaaaatggaagaacagcgcaaagctaacatgctggcgcacatggaaacccagaacaaaatttaca

SEQ ID NO: 411 - DNA, 100 bp, Artificial
  Synthetic
atgccgacgttatcattgagccgaaccgaatcgagtatgttgcgaatgtggatggcaggtcagggaaccattcaaatctctgaccaaatgaatatcaaag

SEQ ID NO: 412 - DNA, 100 bp, Artificial
  Synthetic
cgcgagcgagcgaaaaccaatgcatcgttaatctctatggtgcaacgcttttcagatatcaccatcatgtttgccggactatggctggtttgcgaagtga

SEQ ID NO: 413 - DNA, 100 bp, Artificial
  Synthetic
cctttgaagtggcgcagtttgtcgaaaaaccgaatctggaaaccgcccaggcctatgtggcaagcggcgaatattactggaacagcggtatgttcctgtt

SEQ ID NO: 414 - DNA, 100 bp, Artificial
  Synthetic
agggttactggtttgtgccgggagggcgcgtgcagaaagacgaaacgctggaagccgcatttgagcggctgacgatggcggaactggggctgcgtctgcc

SEQ ID NO: 415 - DNA, 100 bp, Artificial
  Synthetic
ctcggcaatatggattccctgcgtgactggggccatgccaaagactacgtaaaaatgcagtggatgatgctgcaacaggaacagccggaagatttcgtta

SEQ ID NO: 416 - DNA, 100 bp, Artificial
  Synthetic
tataccctcggtgaaataaccattggcgcacattcggtgatatcgcaaaaaagttatttatgcaccggtagccacgaccatgcaagtcaacatttcacca

SEQ ID NO: 417 - DNA, 100 bp, Artificial
  Synthetic
cgaaccggcatttttcgctctggcattaatctcaatttggctcagcatcaaacagtttggtatcaaaacgcctaaaaccgatgctatgattctcgcaggg

SEQ ID NO: 418 - DNA, 100 bp, Artificial
  Synthetic
aggtctttacctgggcgtggcgtttcaaagagtgtttgttcgataccgaactgaaagcggcacaggattacgacatcttcctgcggatggtggtggagta

SEQ ID NO: 419 - DNA, 100 bp, Artificial
  Synthetic
atggtggcgcgttatgcggtcaacacattgaaagaagtggaaaccagtctgagccgctttgagcaaaacggtattccggtgaaaggggtgattctgaact

SEQ ID NO: 420 - DNA, 100 bp, Artificial
  Synthetic
ctgattttgaccatggaaaagcgccatatcgaacgcttatgcgagatggcacctgagatgcgcggcaaagtgatgctgtttggtcactgggataacgaat

SEQ ID NO: 421 - DNA, 100 bp, Artificial
  Synthetic
cccggtttcccgctggaaccgtctgatcaatcagttgctgccaactattagcggtgtccgttacatgacggatacagccagcgacattcataactggtaa

SEQ ID NO: 422 - DNA, 100 bp, Artificial
  Synthetic
aggcagttataaatcccgttgggtaatcgtaatcgtggtggttatcgccgccatcgccgcattctggttctggcaaggccgcaatgactcccagagtgca

SEQ ID NO: 423 - DNA, 100 bp, Artificial
  Synthetic
gcggccgccctgatggcatttaccccgcttgcagcaaacgcaggtgaaatcaccctactgccatcaatcaaattacaaattggcgatcgcgatcattacg

SEQ ID NO: 424 - DNA, 100 bp, Artificial
  Synthetic
cgagttccgtaaagccggacacgaagtgattaccattgaaaaacaagcgggtaaaacggtgaaaggcaaaaaaggagaagccagcgtgaccatcgataaa

SEQ ID NO: 425 - DNA, 100 bp, Artificial
  Synthetic
ttcatcagcaaataacttacgaagcattgcgtgtttgccatgcggtgcgcaaagagccggatattcttacccgccaacggatgattgccgagatatttac

SEQ ID NO: 426 - DNA, 100 bp, Artificial
  Synthetic
tggttatggtgatcagtaaaaccattgccgagctggagcgtattggcgacgtggcggacaaaatctgccgtactgcgctggagaaattctcccagcagca

SEQ ID NO: 427 - DNA, 100 bp, Artificial
  Synthetic
ctgcaaccaagcctgcttttaacccaccgggtaaaaagggcgacataattttcagcgtgctggtaaaactggcggcgctgattgtgctattgatgttggg

SEQ ID NO: 428 - DNA, 100 bp, Artificial
  Synthetic
tatgcgtaccaccgtcgcaactgttgtcgccgcgaccttatcgatgagcgctttctctgtgtttgcagaagcaagcctgacaggtgcaggtgcaaccttc

SEQ ID NO: 429 - DNA, 100 bp, Artificial
  Synthetic
aaaacgaagtgactttcccacatgccgaagttgagcaagcgcgccagatgctggcaaaagcgcaaaaaccgatgctgtacgttggcggtggcgtgggtat

SEQ ID NO: 430 - DNA, 100 bp, Artificial
  Synthetic
gtggttggtgaaatagcagccaattcgatagctgcggaagcacaaattgcaccaggtacggaactaaaagccgtagatggtatcgaaacgcctgattggg

SEQ ID NO: 431 - DNA, 100 bp, Artificial
  Synthetic
tccggcgttgaactgggcgataacgtgattatcggtgccggttgcttcgtaggtaaaaacagcaaaatcggtgcaggttcgcgtctctgggcgaacgtaa

SEQ ID NO: 432 - DNA, 100 bp, Artificial
  Synthetic
ggcgcagtactgacccgctatggtcagcgactgattcagctctatgacttactggcgcaaatccagcaaaaagcctttgatgtgttaagtgacgatgacg

SEQ ID NO: 433 - DNA, 100 bp, Artificial
  Synthetic
tgctacaaatctaccaggctaccagtgagtggcagaaagcaattgatgttgccgaacgcctggtgaagctgggtaaagataaacagcgcgtcgaaattgc

SEQ ID NO: 434 - DNA, 100 bp, Artificial
  Synthetic
atggctaacgcagatctggataaacagcctgattctgtatcttccgtgctaaaagtttttggcattttgcaggcgctgggtgaagagcgcgaaataggga

SEQ ID NO: 435 - DNA, 100 bp, Artificial
  Synthetic
atgttagccgagcgcttcgttcaacctggtacgcaggtttacgatctgggttgttctctgggcgcggcgacgctctcggtgcgtcgcaacattcatcatg

SEQ ID NO: 436 - DNA, 100 bp, Artificial
  Synthetic
gatgtacgcctgggcaataaatttcgtaccttccgtggtcacacggcagcgtttatcgatctgagcggtcccaaagatgaagtgagcgccgcgcttgacc

SEQ ID NO: 437 - DNA, 100 bp, Artificial
  Synthetic
ctgatgacagtttgatggaaacgccgcatcgcatcgctaaaatgtatgtcgatgaaattttctccggtctggattacgccaacttcccgaaaatcaccct

SEQ ID NO: 438 - DNA, 100 bp, Artificial
  Synthetic
gaagtgcgtggtgaagtgttcctgccgcaggcggggttcgaaaagattaacgaagatgcgcgacgcacgggcgggaaagtgtttgctaacccacgtaatg

SEQ ID NO: 439 - DNA, 100 bp, Artificial
  Synthetic
attgcgctgaaagtagcggaatacggcgtcgattgtctgcgtattaaccctggcaatatcggtaatgaagagcgtattcgcatggtggttgactgtgcgc

SEQ ID NO: 440 - DNA, 100 bp, Artificial
  Synthetic
caggccgttgccgagcgactttgcctgaaggtttccacggtacgcgacattgaagaagataaggcacccgccgatcttgcttcaacattcctgcgcggat

SEQ ID NO: 441 - DNA, 100 bp, Artificial
  Synthetic
ggttgataaaggctcggtggcagagtgggcggtaaaaacggtcattgaaaaatttgccgaacagtttgccgcgctaagcgataactatctcaaagagcgg

SEQ ID NO: 442 - DNA, 100 bp, Artificial
  Synthetic
ttgcgctacaaattaccgaaacgtttggtgcgttgggacacgaagccggtttgtatcggccaaaaacaaaaatggtttctcttgcagctggtgagcggcg

SEQ ID NO: 443 - DNA, 100 bp, Artificial
  Synthetic
tttacgcaacatggcccgctggcgatgttgccgatgtctgacggacgctgttcgctggtctggtgtcatccactggaacggcgcgaagaggtgctgtcgt

SEQ ID NO: 444 - DNA, 100 bp, Artificial
  Synthetic
ccacgcgtaatgcgggattgcagggcggcaatagctgggctatttacgatgactcgttgcctgaaaaaggacgcggtaatgttcgctggcgtacgcttat

SEQ ID NO: 445 - DNA, 100 bp, Artificial
  Synthetic
aggatctaaaatgttcagccattcgcattgctaacggtgaacatacaggccggaagattggttcgccaattactgacctggcgctacgtatgctgcacga

SEQ ID NO: 446 - DNA, 100 bp, Artificial
  Synthetic
ccgtggacaccacgtcacaacctgtcgcaacagaaaaaaagagtaagaacaataccgcattgattctcagcgcggtggctatcgctattgctctggcggc

SEQ ID NO: 447 - DNA, 100 bp, Artificial
  Synthetic
gagcagcccaccgcgcaattgcccttttccgcgctctgggcgttgttgatcggtattggtatcgcctttacgccatgcgtgctgccaatgtacccactga

SEQ ID NO: 448 - DNA, 100 bp, Artificial
  Synthetic
attgaaacggtgaaaatgctcgacgcacgtattcagaccatggacaaccaggccgaccgctttgtgaccaaagagaagaaagacctgatcgtcgactctt

SEQ ID NO: 449 - DNA, 100 bp, Artificial
  Synthetic
cggcgagtgcgatacgtattggtgatgtggtgcgcgagctggagcccttatcgctggtgaattgcagcagtgagttttgccacattacacctgcctgtcg

SEQ ID NO: 450 - DNA, 100 bp, Artificial
  Synthetic
gtctattttgaaaagccgcgtaccacggtgggctggaaagggctgattaacgatccgcatatggataacagcttccagatcaacgacggtctgcgtatag

SEQ ID NO: 451 - DNA, 100 bp, Artificial
  Synthetic
gtaatgaaagggcagattgctcgcatgcaccgcgcactgtcgcagtttatgctggatctgcataccgaacagcatggctacagtgagaactatgttccgt

SEQ ID NO: 452 - DNA, 100 bp, Artificial
  Synthetic
tctgaaatcaaccgtacccatgaaatccttcaggatgataagaagtgcgagctgattgtggttatcgactgccacatgacctcatcggcgaaatatgctg

SEQ ID NO: 453 - DNA, 100 bp, Artificial
  Synthetic
cgcaaaccggtgcaactcatttccggttatcgttccattgataccaacaatgaactacgcgcccgcagccgtggagtagcgaagaaaagctatcacacta

SEQ ID NO: 454 - DNA, 100 bp, Artificial
  Synthetic
atgatgaagcgcaatattctggcagtgatcgtccctgctctgttagtagcaggtactgcaaacgctgcagaaatctataacaaagatggcaacaaagtag

SEQ ID NO: 455 - DNA, 100 bp, Artificial
  Synthetic
aaaaaccaagagtactcgtactgacaggggcagggatttctgcggaatcaggtattcgtacctttcgcgccgcagatggcctgtgggaagaacatcgggt

SEQ ID NO: 456 - DNA, 100 bp, Artificial
  Synthetic
acctacctgaccaaagtggatgtcgaagcgcgcctgcagcatattatgtttgcccgtaacagccagaaaatgcacatcccggagaattttaccgtctcgt

SEQ ID NO: 457 - DNA, 100 bp, Artificial
  Synthetic
gttgcggttacaccggaaagtcagcaactgctggcaaaagcggtatctatcgccaggccagtaaagggacacatcagtttaattactctcgcttccgacc

SEQ ID NO: 458 - DNA, 100 bp, Artificial
  Synthetic
tggacgttacgccgctgatgcgcgttgatggtttcgccatgctttacaccgggctggtattgttggcgagcctcgccacctgtactttcgcctacccgtg

SEQ ID NO: 459 - DNA, 100 bp, Artificial
  Synthetic
cttctgggaaatgatgctggtgccgatgtacttcctgatcgcactgtgggggcataaagcctctgacggtaaaacgcgtatcacggcggcaaccaagttc

SEQ ID NO: 460 - DNA, 100 bp, Artificial
  Synthetic
gtatctggatgatcggcctgcacgcgttcgccaaacgcgaaacgcgaatgtacccggaagagccggtctatctgccgccccgttatcgtggtcgtatcgt

SEQ ID NO: 461 - DNA, 100 bp, Artificial
  Synthetic
ctcacccatccggtgtttaatcgctaccacagcgaaaccgaaatgatgcgctatatgcactcgctggagcgtaaagatctggcgctgaatcaggcgatga

SEQ ID NO: 462 - DNA, 100 bp, Artificial
  Synthetic
ccactgcggtagataaaatcgtgctcaaccgtttcctcggtctgccgattttcctctttgtgatgtacctgatgttcctgctggctatcaacatcggcgg

SEQ ID NO: 463 - DNA, 100 bp, Artificial
  Synthetic
cggaagcagacagcagtctggaagcgttatatgaccgcatgctgattcgtctgtggttagataaagtgcaggataaagcgaatttccgctccatgctgac

SEQ ID NO: 464 - DNA, 100 bp, Artificial
  Synthetic
aagatgttcaccgtgctggtggtgttatcggtattctcggcgaactggatcgcgcggggttactgaaccgtgatgtgaaaaacgtacttggcctgacgtt

SEQ ID NO: 465 - DNA, 100 bp, Artificial
  Synthetic
tggcagcgaagctcgagcaaaacaaagaagttgcttatctctcataccagctggcgacgattaaaaccgacgttgaactggagctgacctgtgaacaact

SEQ ID NO: 466 - DNA, 100 bp, Artificial
  Synthetic
cttcattctcgctggaaactgtcgctcaggagctattaggcgaaggaaaatctatcgataacccgtgggatcgaatggacgaaattgaccgccgtttcgc

SEQ ID NO: 467 - DNA, 100 bp, Artificial
  Synthetic
aaaacggtcacggtcaccaaaggctggagcgaagcctacggcctgtttttaaaaggtgaaagcgatctggtactgagttacaccacctctccggcttatc

SEQ ID NO: 468 - DNA, 100 bp, Artificial
  Synthetic
ccgcgaacgtcggggggtgatcagcaccgccaattatcccgcgcgtaaatttggcgtacgtagcgctatgccgacagggatggcgctcaaattatgcccg

SEQ ID NO: 469 - DNA, 100 bp, Artificial
  Synthetic
cgtggaagcctggaccgatatgttcccggaatttggtggcgactcctcggcgcagaccgacaactttatgaccaaacgcgccagcggtctggcgacgtat

SEQ ID NO: 470 - DNA, 100 bp, Artificial
  Synthetic
gcgtttctacggggatcatcagccactatttcagggacaaaaatggtctgctggaagcaaccatgcgcgatatcaccagtcagctgcgtgacgcggtttt

SEQ ID NO: 471 - DNA, 100 bp, Artificial
  Synthetic
gaaatggtctgcttcgtgctcgaacaaaatggctttcagccggtcgaagcggaagattatgacagtgctgtgaatcaactgaatgaaccctggccggatt

SEQ ID NO: 472 - DNA, 100 bp, Artificial
  Synthetic
gtgctgaccacggaagagggcggtattttctggtgtaacggtctggcgcaacaaattcttggtttgcgctggccggaagataacgggcagaacatcctta

SEQ ID NO: 473 - DNA, 100 bp, Artificial
  Synthetic
tcgatgtctacccacgctaccgctatgaagatatcgacgtgctggatttccgcgtttgctataacggcgaatggtacaacacgcgctttgtacctgccgc

SEQ ID NO: 474 - DNA, 100 bp, Artificial
  Synthetic
tatacaaacgtctgatcgatatgggtgaagaaattggtctggctacggtatatcgcgtactgaaccagtttgacgacgctggtatcgtcacccgccacaa

SEQ ID NO: 475 - DNA, 100 bp, Artificial
  Synthetic
tacggcatgatgctgtttgtcctgctggcggtgtttattgccgggctgatgattggtcgtacaccggaatatctgggtaaaaaaatcgacgtacgcgaga

SEQ ID NO: 476 - DNA, 100 bp, Artificial
  Synthetic
gagatgatgaacgagctgggctactgttcggggattgaaaactactcgcgcttcctctccggtcgtggaccgggtgagccaccgccgacgctgtttgatt

SEQ ID NO: 477 - DNA, 100 bp, Artificial
  Synthetic
tgtctatcgcgaagatcagcccatgatgacgcaacttctactgttgccattgttacagcaactcggtcagcaatcgcgctggcaactctggttaacaccg

SEQ ID NO: 478 - DNA, 100 bp, Artificial
  Synthetic
tgcgaattgaagtcaccatagcgaaaacttctccattgccagctggggctattgacgccctggctggcgaactttcccgccgtattcagtatgcgtttcc

SEQ ID NO: 479 - DNA, 100 bp, Artificial
  Synthetic
gttgatccagcatcccagcgcgacttacttcgtcaaagcaagtggtgattctatgattgatggtggaattagtgacggtgatttactgattgtcgatagc

SEQ ID NO: 480 - DNA, 100 bp, Artificial
  Synthetic
cggcaaaaaaatggcagcggcagacgggtggggtggtggatttatcaaatctggaacgccagcgtaaattaatgtctgctctccccgtggatgacgtctg

SEQ ID NO: 481 - DNA, 100 bp, Artificial
  Synthetic
aacgacaacctgatggaattagtcgttatggttgatgccctgcgtcgtgcttccgcaggtcgtatcaccgctgttatcccctactttggctatgcgcgcc

SEQ ID NO: 482 - DNA, 100 bp, Artificial
  Synthetic
tctattgcttgtgcggtatttgccaaaaatgccgagctgacgcccgtgctggcacagggtgactggtggcatattgtcccttccgcaatcctgacgtgtt

SEQ ID NO: 483 - DNA, 100 bp, Artificial
  Synthetic
cacctggctgacaaattctccagtgcaaatggaagacgagcaacgtgaagccctttcgctatggctggcagaacaaaaagatgtgctgagcaccattctg

SEQ ID NO: 484 - DNA, 100 bp, Artificial
  Synthetic
ctgccagatgtccgagatggcctgaagccggtacaccgtcgcgtactttacgccatgaacgtactaggcaatgactggaacaaagcctataaaaaatctg

SEQ ID NO: 485 - DNA, 100 bp, Artificial
  Synthetic
gacaaagcgcgacggtagcacagagcgcatcaatctcgacaaaatccatcgcgttctggattgggcggcagaaggactgcataacgtttcgatttcccag

SEQ ID NO: 486 - DNA, 100 bp, Artificial
  Synthetic
gttgtcggtatgtaccgtaatgaagaaacgctggagccggtaccgtacttccagaaactggtttctaacatcgatgagcgtatggcgctgatcgttgacc

SEQ ID NO: 487 - DNA, 100 bp, Artificial
  Synthetic
tgattaatgcgaccggtgaaacgctcgacaaattgctgaaggatgatctacctgtggtgatcgacttctgggcaccgtggtgcggcccctgccgtaattt

SEQ ID NO: 488 - DNA, 100 bp, Artificial
  Synthetic
taatccgcagcccggagagtttgaacaaatcgacgaagagtacaaacgtctggcgaacagcggtcaattgctgaccaccagccagaatgcattggcatta

SEQ ID NO: 489 - DNA, 100 bp, Artificial
  Synthetic
gaacatcttaattgcatggccatacggtatgtaccgcgatctgtttatgcgcgcggcacgcaaagttagcccgtcgggctggataaaaaatctggcggat

SEQ ID NO: 490 - DNA, 100 bp, Artificial
  Synthetic
aagcgacagaaaaagcgatgcgtgaatgtgacatcgactggtgcgcactggcgcgcgatcaggcgacgcgaaaatatggcgaacctttgccaactgtctt

SEQ ID NO: 491 - DNA, 100 bp, Artificial
  Synthetic
aaagcgttggcggcagcactgggccagattgagaaacaatttggtaaaggctccatcatgcgcctgggtgaagaccgttccatggatgtggaaaccatct

SEQ ID NO: 492 - DNA, 100 bp, Artificial
  Synthetic
tgaaagcggctcgtgctgattatgccgtgtctattagtggtatcgccgggccggatggcggcagtgaagagaagcctgtcggcaccgtctggtttgcttt

SEQ ID NO: 493 - DNA, 100 bp, Artificial
  Synthetic
gataacccgctgttatgaaaaaatgctcgccgccagtgagaacaacaaagagatttcgctgatcgaacatgcgcagttggatcacgctttccatctcgcc

SEQ ID NO: 494 - DNA, 100 bp, Artificial
  Synthetic
tcaagcgttcctgcgaaaaagcaggtgttctggcggaagttcgtcgtcgtgagttctatgaaaaaccgactaccgaacgtaagcgcgctaaagcttctgc

SEQ ID NO: 495 - DNA, 100 bp, Artificial
  Synthetic
agagcatcaaagattactctcaattgcaaacacggtgccgtattttcaattatcagtcagggatacaggtattgatacctacgtgttgattgtgggggag

SEQ ID NO: 496 - DNA, 100 bp, Artificial
  Synthetic
agagccgactggcttttcaggaaatcaccattgaagaactgaacgtcacggtgaccgctcatgaaatggagatggcgaaactgcgcgatcatctgcgtct

SEQ ID NO: 497 - DNA, 100 bp, Artificial
  Synthetic
cctattttcatgtccgtactgaaacatactgaaccgaaaagacggcgggcaatcatggtgcgagagttgcttattgctctcctggtgatgctggtgttcc

SEQ ID NO: 498 - DNA, 100 bp, Artificial
  Synthetic
ttgcctcagtatggaagcaaatcagctacaacttcctgttcttctatgccgcgctgcaatccattccccgttcgttgatcgaagccgcagccatcgacgg

SEQ ID NO: 499 - DNA, 100 bp, Artificial
  Synthetic
aaggggaactgggtaaagaggtggattctctggcccaacgttttaacgccgaaaacccggattacaaaattgtaccgacctataaaggcaactacgaaca

SEQ ID NO: 500 - DNA, 100 bp, Artificial
  Synthetic
ttcatctctcccgctatgcctgttacctggtagtacaaaacggcgaccctgcgaaaccggttattgcggcagggcaaacttattttgctatccagacccg

SEQ ID NO: 501 - DNA, 100 bp, Artificial
  Synthetic
aagaggacaaagagacagaatctaccgatatgaccaagtggcagatctttgttgagtatgtgctgaaaaacaaagtgatctggctgctgtgcttcgccaa

SEQ ID NO: 502 - DNA, 100 bp, Artificial
  Synthetic
gcttaagctgttgatgtgcgccttacgtctggcgcaaggagagttcctcacccgtgaaagcgggcggcggtgtctctacctgatagatgattttgcctct

SEQ ID NO: 503 - DNA, 100 bp, Artificial
  Synthetic
ccgctacaacaggtgagcggtccgttaggtggtcgtcctacgctaccgattctcggtaatctgctgttacaggttgctgacggtacgttgtcgctgaccg

SEQ ID NO: 504 - DNA, 100 bp, Artificial
  Synthetic
tcccggccccggcagaaccgacctatcgttctaacgtaaacgtcaaacacacgtttgataacttcgttgaaggtaaatctaaccaactggcgcgcgcggc

SEQ ID NO: 505 - DNA, 100 bp, Artificial; identical to SEQ ID NO: 427
  Synthetic

SEQ ID NO: 506 - DNA, 100 bp, Artificial
  Synthetic
ttatgcgtaccaccgtcgcaactgttgtcgccgcgaccttatcgatgagcgctttctctgtgtttgcagaagcaagcctgacaggtgcaggtgcaacctt

SEQ ID NO: 507 - DNA, 100 bp, Artificial
  Synthetic
gtgtgcgtgggaagtaccttaacccgccacgaaaccatcagtgaagatgaactacgccagcggctatcgcggatggggaccattgatcttcgcgttgatt

SEQ ID NO: 508 - DNA, 100 bp, Artificial
  Synthetic
cgctacaggaacatatcgcgtcggtgcgtaaccatatccgtttgctgggacgcaaagattatcaacagctgccggggctgcgaactctggattacgtgct

SEQ ID NO: 509 - DNA, 100 bp, Artificial
  Synthetic
agatggcattgccgaactggtatttgatgccccaggttcagttaataaactcgacactgcgaccgtcgccagcctcggcgaggccatcggcgtgctggaa

SEQ ID NO: 510 - DNA, 100 bp, Artificial
  Synthetic
taacggccaggcaacaagaggtgtttgatctcatccgtgatcacatcagccagacaggtatgccgccgacgcgtgcggaaatcgcgcagcgtttggggtt

SEQ ID NO: 511 - DNA, 100 bp, Artificial
  Synthetic
tactcggcgtgcaatatgcccgtgcgccagtaattttgttagtggtcggcaatatcctcaacattgtgctggatgtctggctggtgatggggctgcatat

SEQ ID NO: 512 - DNA, 100 bp, Artificial
  Synthetic
ccccgcgacaagctcattgtcgtgaccgggctttcgggttctggcaaatcctcgctcgctttcgacaccttatatgccgaagggcagcgccgttacgttg

SEQ ID NO: 513 - DNA, 100 bp, Artificial
  Synthetic
atggctaccctcaccactggcgtggttcttcttcgctggcaacttcttagtgccgtaatgatgtttctggccagcacactcaacatccgttttcgtcggt

SEQ ID NO: 514 - DNA, 100 bp, Artificial
  Synthetic
cgcctgttactggccgccgttgagttgcgcaccaccgagcgtccgatttttgatatcgcaatggacctgggttatgtctcgcagcagaccttctcccgcg

SEQ ID NO: 515 - DNA, 100 bp, Artificial
  Synthetic
  misc_feature (90)..(100): n is a, c, g, or t
aacaaagatagtccgatcaacaacctgaacgatctgctggcgaagcggaaagatctcaccttcggcaatggcgatcctaactccacctcnnnnnnnnnnn

SEQ ID NO: 516 - DNA, 100 bp, Artificial
  Synthetic
accgtggtcgtcacgctgcatcaggtggattacgccctgcgctactgcgaacgcatcgtcgccctgcgccaggggcacgtcttctacgacggcagcagcc

SEQ ID NO: 517 - DNA, 100 bp, Artificial
  Synthetic
ttgcatgatcgcgtgatcgtcaagcgtaaagaagttgaaactaaatctgctggcggcatcgttctgaccggctctgcagcggctaaatccacccgcggcg

SEQ ID NO: 518 - DNA, 100 bp, Artificial
  Synthetic
agcgatggacaaagtcggtaaagaaggcgttatcaccgttgaagacggtaccggtctgcaggacgaactggacgtggttgaaggtatgcagttcgaccgt

SEQ ID NO: 519 - DNA, 100 bp, Artificial
  Synthetic
aaactcggctatgttagccgttatgcgctgggccgtgactatcacaaacttctgcgcaaccgactcaaaaagctgggcgagatgattcagcaacattgtg

SEQ ID NO: 520 - DNA, 100 bp, Artificial
  Synthetic
cgtgttagtgagcaggaaagcgagccgaatgcctttcagcaagggatcagccgcgtcagtatgctgctgattcgctttatgctggtgatggctccggtgg

SEQ ID NO: 521 - DNA, 100 bp, Artificial
  Synthetic
gctgccagcggcggttacatgatggcctgtgtggcggacaaaattgtttccgcaccgtttgctattgtgggttccattggggtggtggcgcaaatgccca

SEQ ID NO: 522 - DNA, 100 bp, Artificial
  Synthetic
acgaaaacatcgcccatgatgacaagccaggtctgtacttccatgaagaatatgtcgatatgtgccgcggtccgcacgtaccgaacatgcgtttctgcca

SEQ ID NO: 523 - DNA, 100 bp, Artificial
  Synthetic
acaaatggcgttaagccagatcgaaccagaaaaaacagaaagcccatttgccagtttgtctgaacgtgaattgcagattatgctgatgatcaccaagggc

SEQ ID NO: 524 - DNA, 100 bp, Artificial
  Synthetic
cggacacctttggtcgcgtgccgaacaaagagagcaaaaaaccggaaatcaccgtgccggtagtcaccgacgcgcaaaagggcattatcattcattacgt

SEQ ID NO: 525 - DNA, 100 bp, Artificial; identical to SEQ ID NO: 442
  Synthetic

SEQ ID NO: 526 - DNA, 100 bp, Artificial
  Synthetic
tccaaatttttggccgttcactgcgtgtgaactgcccgcctgaccaaagggatgcgttgaatcaggcagcggacgatctgaaccaacggttgcaagatct

SEQ ID NO: 527 - DNA, 100 bp, Artificial
  Synthetic
catgcgcatccgcaggatttaatgcaaaaatcggtgcagccgttgccaaaatcgatcaagcgcacagccattctgctcactctcggcatcagtctgcata

SEQ ID NO: 528 - DNA, 100 bp, Artificial
  Synthetic
cgagcaggtcatgttggtcaccaacgaaaccctggctcctctgtatctcgataaggtccgcggcgtacttgaacaggcgggtgttaacgtcgatagcgtt

SEQ ID NO: 529 - DNA, 100 bp, Artificial
  Synthetic
  misc_feature (86)..(88): n is a, c, g, or t
ggttggtgccgctggcgaaggcattggcgaaagcgatgtccgcgtcaattttggcggtgtcaccttcttctccggcgaccatcttnnntatgccgacaat

SEQ ID NO: 530 - DNA, 100 bp, Artificial
  Synthetic
actggcgtgaatctatcgatcccatcgaagcggtgcgtccggcctggttaacgccgacggtcaataatattgctgccgatctgatggtacgcattaacaa

SEQ ID NO: 531 - DNA, 100 bp, Artificial
  Synthetic
cgttgtgctgttcggcaaactggcagaagtggccagcgaatatctgcgtaaaggttctcaggtttatatcgaaggtcagctgcgtacccgtaaatggacc

SEQ ID NO: 532 - DNA, 100 bp, Artificial
  Synthetic
gcctgcggttgtcgcaccgcgcgtcagcgaaccggcgcgcaatccgtttaaaacggaaagtaaccgcactacgggtgttatcagcagtaatacggtaacg

SEQ ID NO: 533 - DNA, 100 bp, Artificial
  Synthetic
gaagaagtaaaagcggcgtttgacgatgcgattgccgcgcgtgaaaacgaacagcaatacattcgtgaagcagaagcgtataccaacgaagttcagccgc

SEQ ID NO: 534 - DNA, 100 bp, Artificial; identical to SEQ ID NO: 448
  Synthetic

SEQ ID NO: 535 - DNA, 100 bp, Artificial
  Synthetic
cgcagctgggcattgcgctcggcctgcataaagccttctgggatattgattataacagtggcgaacgttaccgctttgggcatgtgacctttgaaggatc

SEQ ID NO: 536 - DNA, 100 bp, Artificial
  Synthetic
acaccatcgaacaccatctttccgcagacgatctggaaaccctggaaaaagcagcagttgaagcgtttaaactcggttacgaagtgaccgatccagaaga

SEQ ID NO: 537 - DNA, 100 bp, Artificial
  Synthetic
tggcgcagtggagccaactgcttggcgaaaccagcgcggtaatgggcaccgttggtaacggcctgctggggaaagtgatcccgacagaaaataccaccgg

SEQ ID NO: 538 - DNA, 100 bp, Artificial
  Synthetic
ttttaagccagtgcggcaacacgctttatacggcaggcaatctcaacaacgacatcggtgtaccgatgacgctgttgcgcttaacgccggaatacgatta

SEQ ID NO: 539 - DNA, 100 bp, Artificial
  Synthetic
cctgctggtgattatggggggcgtgttcgtggtagaaacgctttctgtcatcctgcaggtcggctcctttaaactgcgcggacaacgtattttccgcatg

SEQ ID NO: 540 - DNA, 100 bp, Artificial
  Synthetic
ggacgaagaatcgggtgctggttaaaggcctgatctctcctgctgtctcgctggtgtacgccaccttgctgggtattgctggctttatgctgctgtggtt

SEQ ID NO: 541 - DNA, 100 bp, Artificial
  Synthetic
gatcattctgacggtgattccgttctggatggtgatgacaggggctgcctctccggccgtaattctgggaacaatcctggcaatggcagtggtacaggtt

SEQ ID NO: 542 - DNA, 100 bp, Artificial
  Synthetic
gcaggcggcccgacaggtaaggacattttcgaactgccgttcgttctggttgaaactttcttgctgttgttcagctccatcacctacggcatggcggcta

SEQ ID NO: 543 - DNA, 100 bp, Artificial
  Synthetic
tctcccgctatgcgccggatatgaatcatgtcacagccgcacagtaccaggcggcgatgcgtggcgcgatacctcaggttgcgccggtattctggagttt

SEQ ID NO: 544 - DNA, 100 bp, Artificial
  Synthetic
tcttccgtccggtcggttttgactaccgctccaagattgaagaaacccgctggcgtaacatgtgggactggggcatcttcattggtagcttcgttccgcc

SEQ ID NO: 545 - DNA, 100 bp, Artificial
  Synthetic
tgttttgggacccatctcgttttgccgcgaagaccagtgaactggaaatctggcatggtttattgctgatgtgggccgtctgtgctggtgtgattcacgg

SEQ ID NO: 546 - DNA, 100 bp, Artificial
  Synthetic
tggcgggcgaagggatgttaatcctctggagtacctcgtatctcgacgaagccgagcagtgccgtgacgtgttactgatgaacgaaggcgagttgctgta

SEQ ID NO: 547 - DNA, 100 bp, Artificial
  Synthetic
ccggagcatcgcacggcgttgatcatgcctatctgtaacgaagacgtgaaccgtgtttttgctggcctgcgtgcaacgtgggaatcagtaaaagccaccg

SEQ ID NO: 548 - DNA, 100 bp, Artificial
  Synthetic
gctggcaatgaccggggttgttatccccagttttgtggttgcgccattattagtcatgatatttgcgatcattttgcattggctgccgggcggtggctgg

SEQ ID NO: 549 - DNA, 100 bp, Artificial
  Synthetic
gaaactctgccccgtgtcattggtgggcgctatggtctttcatccaaagaatttggcccggactgtgtactggcggtatttgccgagctcaacgcggcta

SEQ ID NO: 550 - DNA, 100 bp, Artificial
  Synthetic
ccgggtactcatcctcggggtgaatggctttattggcaaccatctgacagaacgcctgctgcgcgaagatcattatgaagtttacggtctggatattggc

SEQ ID NO: 551 - DNA, 100 bp, Artificial; identical to SEQ ID NO: 458
  Synthetic

SEQ ID NO: 552 - DNA, 100 bp, Artificial; identical to SEQ ID NO: 459
  Synthetic

SEQ ID NO: 553 - DNA, 100 bp, Artificial
  Synthetic
gacatcaaacgtgttctcgcttactctaccatgagccagattggctacatgttcctcgcgcttggcgtgcaggcatgggatgcggcgattttccacttga

SEQ ID NO: 554 - DNA, 100 bp, Artificial
  Synthetic
gtgatgtacattctcgccatcagcctcgcggcggcagaagcgagtatcggccttgcgctgctgctgcaacttcaccgtcgtcgccagaacctgaacatcg

SEQ ID NO: 555 - DNA, 100 bp, Artificial
  Synthetic
tggtggtgattgtttacgccatcctcggtgttaacgatcagggtatcgacggtacgccaatcagtgctaaagcagtgggtattacgctgttcgggcctta

SEQ ID NO: 556 - DNA, 100 bp, Artificial; identical to SEQ ID NO: 460
  Synthetic

SEQ ID NO: 557 - DNA, 100 bp, Artificial
  Synthetic
atcgggattgtgaccatctctgcattgatggtgacgctgttcttcggtggctggcaaggcccgttgttaccgccattcatctggttcgcgctgaaaaccg

SEQ ID NO: 558 - DNA, 100 bp, Artificial
  Synthetic
caataccaaaacgcggaagacacgcgtggtcgcctggtgatgtcctgtatgacaccggcttccgatggcacctttatttccattgacgacgaagaagcga

SEQ ID NO: 559 - DNA, 100 bp, Artificial
  Synthetic
gaaaccctgtgtaacgttccggcgatcctcgctaacggcgtggagtggtatcagaacatctcgaaaagtaaagatgctggcaccaagctgatgggcttct

SEQ ID NO: 560 - DNA, 100 bp, Artificial
  Synthetic
cttttgagctgagtgcggcagagcgtgaagcgattgagcacgagatgcaccactacgaagacccgcgtgcggcgtccattgaagcgctgaaaatcgttca

SEQ ID NO: 561 - DNA, 100 bp, Artificial
  Synthetic
aaagaaactgccgaaaccttacgtcatgctgtttgacttacacggcatggacgaacgtctgcgcacacaccgcgaagggttacctgccgcggatttttcc

SEQ ID NO: 562 - DNA, 100 bp, Artificial
  Synthetic
tgccaacgggcactggaattgatcgaacagcaggccgcaaaacacggcgcaaaacgcgtaactggggtctggctcaaaattggcgcattttcttgtgtcg

SEQ ID NO: 563 - DNA, 100 bp, Artificial
  Synthetic
atgtgtacaacatgcggttgcggtgaaggcaacctgtatatcgagggtgatgaacataaccctcattccgcgtttcgtagcgcgccatttgccccggcgg

SEQ ID NO: 564 - DNA, 100 bp, Artificial
  Synthetic
aaatagcggcccacagcaaggtagagaatcagtatcgtcgggtggtaccggatgccggtaacctgctggcgcaacaggcgattgccgatgtgttctgtgt

SEQ ID NO: 565 - DNA, 100 bp, Artificial
  Synthetic
caatatcaccattttagcaaccggcgggaccattgccggtggtggtgactccgcaaccaaatctaactacacagcgggtaaagttggcgtagaaaatctg

SEQ ID NO: 566 - DNA, 100 bp, Artificial
  Synthetic
  misc_feature (83)..(100): n is a, c, g, or t
ggttctggtactgacgggtgtgccttatgaaaatctcgacctgccgaaactggacgatctttctaccggtgcgcgttccgaannnnnnnnnnnnnnnnnn

SEQ ID NO: 567 - DNA, 100 bp, Artificial
  Synthetic
taacacctgccggtcaattgttactctcccgttccgaatccattacccgtgaaatgaaaaatatggttaatgagataagcggtatgtcttctgaggcggt

SEQ ID NO: 568 - DNA, 100 bp, Artificial
  Synthetic
cagctattagaagaagaacgcgaacaactgttgagtgaagttcaggaacgcatgacgctgagcggacaacttgaaccgattctcgcagataacaataccg

SEQ ID NO: 569 - DNA, 100 bp, Artificial
  Synthetic
cagtgattgagaatctggagaaggcatcgactcaggagctggaagatatggccagcgcactgtttgcctctgatttctcgtccgtcagcagcgataaagc

SEQ ID NO: 570 - DNA, 100 bp, Artificial
  Synthetic
tcgtcaacgaggaagtaggtgacaccgggcgttataacttcggtcagaaatgcgttttctgggcggcgattattttcctggttctgctgctggtgagcgg

SEQ ID NO: 571 - DNA, 100 bp, Artificial
  Synthetic
tgggtcaccagaaaggtgaatatcagtacctgaacccgaacgaccatgttaacaaatgtcagtccactaacgacgcctacccgaccggtttccgtatcgc

SEQ ID NO: 572 - DNA, 100 bp, Artificial
  Synthetic
tgtttgccctgaaaaatggcccggaagcctgggcgggattcgtcgactttttacaaaacccggttatcgtgatcattaacctgatcactctggcggcagc

SEQ ID NO: 573 - DNA, 100 bp, Artificial
  Synthetic
tcctgccgtatggcgatttgtggttcctgcggcatgatggttaacaacgtgccaaaactggcatgtaaaaccttcctgcgtgattacaccgacggtatga

SEQ ID NO: 574 - DNA, 100 bp, Artificial
  Synthetic
gcgagaaaaaactgcatgaacgtctgccgttcatctgcgaactggcgaaagcgtacgttggcgtcgatccggttaaagaaccgattccggtacgtccgac

SEQ ID NO: 575 - DNA, 100 bp, Artificial
  Synthetic
acgcctgattggccgccgcttccaggacgaagaagtacagcgtgatgtttccatcatgccgttcaaaattattgctgctgataacggcgacgcatgggtc

SEQ ID NO: 576 - DNA, 100 bp, Artificial
  Synthetic
tttcggcgatatttttggcggcggacgtggtcgtcaacgtgcggcgcgcggtgctgatttacgctataacatggagctcaccctcgaagaagctgtacgt

SEQ ID NO: 577 - DNA, 100 bp, Artificial
  Synthetic
ttgatggctctggctattatcgacgatcttggggccatcattatcatcgcattgttctacactaatgacttatcgatggcctctcttggcgtcgcggctg

SEQ ID NO: 578 - DNA, 100 bp, Artificial
  Synthetic
cggcggcaacatcggtatcggttttgctatcccgagcaacatggtgaaaaacctgacctcgcagatggtggaatacggccaggtgaaacgcggtgagctg

SEQ ID NO: 579 - DNA, 100 bp, Artificial
  Synthetic
ctgactgcgtgccgatgctgcgtctggagtttaccggtcaatcggtcgatgccccactgctttctgaaaccgcgcgtcgtttcaacgtcaacaacaacat

SEQ ID NO: 580 - DNA, 100 bp, Artificial; identical to SEQ ID NO: 470
  Synthetic

SEQ ID NO: 581 - DNA, 100 bp, Artificial
  Synthetic
tgccagacaattgacacgctggagcgtgttatcgagaaaaataaatacgaattatcagataatgaactggcggtattttactcagccgcagatcaccgcc

SEQ ID NO: 582 - DNA, 100 bp, Artificial
  Synthetic
gcgttacctgagctggttgatcaggtggttgaagtggtacagcgccatgcgccaggtgactacaccccaacggtaaaaccaagcagcaaaggcaactacc

SEQ ID NO: 583 - DNA, 100 bp, Artificial
  Synthetic
tccgcacgaccgaccctttgtcgaaaatatcggctataacttcctgcatcatgcggcggatgactcattcccaagcgatcacggtacggtgattttcacc

SEQ ID NO: 584 - DNA, 100 bp, Artificial
  Synthetic
gtctggcggcctatggcggcgtttatttgcttcacggtacgaacgccgatttcggcattggcatgcgggtaagttctggctgtattcgtctgcgggatga

SEQ ID NO: 585 - DNA, 100 bp, Artificial
  Synthetic
cgagctggaaaacaaattgagcgaaacacgcgctcgccagcaggcattgatgttacgccatcaggcggcaaactcgtcgcgcgatgtgcgtcgtcagctg

SEQ ID NO: 586 - DNA, 100 bp, Artificial
  Synthetic
gcattacagcaatcgttctggtcgcagtgaattgtcgcaaagtgagcagcagcgattagcgcaactggctgatgaagcaaaacggatgcgcgaacgtatt

SEQ ID NO: 587 - DNA, 100 bp, Artificial
  Synthetic
gatgtaccggtaaaactggtgcgtatcctggtggtgctgtcgattttcttcggtctggcgctgtttaccctggttgcttacatcattttgtcatttgcgc

SEQ ID NO: 588 - DNA, 100 bp, Artificial; identical to SEQ ID NO: 408
  Synthetic

SEQ ID NO: 589 - DNA, 100 bp, Artificial
  Synthetic
aaagatcgtctgcttaacgagtatctgtctccgctggatattaccgcggcacagtttaaggtgctctgctctatccgctgcgcggcgtgtattactccgg

SEQ ID NO: 590 - DNA, 100 bp, Artificial
  Synthetic
ggttactccaaatggcacctgcaacggatgtttaaaaaagaaaccggtcattcattaggccaatacatccgcagccgtaagatgacggaaatcgcgcaaa

SEQ ID NO: 591 - DNA, 100 bp, Artificial
  Synthetic
cggcggtgctggctgcctttagtgcgctttctcaggccgttaaagggatcgacttgtctgtcgcttatgcattgtggggcgggtttggtattgccgccac

SEQ ID NO: 592 - DNA, 100 bp, Artificial; identical to SEQ ID NO: 482
  Synthetic

SEQ ID NO: 593 - DNA, 100 bp, Artificial
  Synthetic
aacgaacctggccgtaatggtcgttttcgggctggtactgagcctgacagggatacagtcgagcagcgttcaggggctgatgatcatggccttgctgttc

SEQ ID NO: 594 - DNA, 100 bp, Artificial
  Synthetic
aggatgcccatgcacgagcccatgccaatgacattaaacgacgctttgatggtagagaggtcaccaactggcaaattttgctatttggcttaaccggtgg

SEQ ID NO: 595 - DNA, 100 bp, Artificial
  Synthetic
atacgccgatgaactggcaaaattaaaacaaaatgataacgcaccttgcccgcccggttggcagttaagtttgcctgcggcccgtgcttttatccttggc

SEQ ID NO: 596 - DNA, 100 bp, Artificial
  Synthetic
cggtgacaacagcctggtggcgcttaaattgcttagcccggatggtgataatgcatggtcggtgatgtataaactaagccaggcgttaagcgacatcgaa

SEQ ID NO: 597 - DNA, 100 bp, Artificial
  Synthetic
atggcggttcgcgtcaacaacgttattccgccaccaaatgggatgtggctatcgccatgacgattgccggttttgtcaatctggcgatgatggctacagc

SEQ ID NO: 598 - DNA, 100 bp, Artificial
  Synthetic
tttcccgtctgcgtaaaaatggtctggtttccagcgtacgtggaccaggcggtggttatctgttaggcaaagatgccagcagcatcgccgttggcgaagt

SEQ ID NO: 599 - DNA, 100 bp, Artificial; identical to SEQ ID NO: 487
  Synthetic

SEQ ID NO: 600 - DNA, 100 bp, Artificial
  Synthetic
gcaccagcgcgggagagctgacgcgcattaccggactgagtgcctctgcgacatcacagcatctcgctcgtatgcgggacgaagggcttatcgacagcca

SEQ ID NO: 601 - DNA, 100 bp, Artificial; identical to SEQ ID NO: 493
  Synthetic

SEQ ID NO: 602 - DNA, 100 bp, Artificial
  Synthetic
ttggcattcttttggcgctcaccacagcaatttgctggggggcgttgccaatcgcaatgaagcaggtgctggaggtgatggaacctccgacaatcgtgtt

SEQ ID NO: 603 - DNA, 100 bp, Artificial
  Synthetic
atgctgcacacattacatcgttcaccctggctgacggattttgctgcgctgctgcgtctgctcagtgaaggagacgaactgctattattgcaagatggcg

SEQ ID NO: 604 - DNA, 100 bp, Artificial
  Synthetic
gttacgccacaggaagcgatggaatatatgcgccagcaatatcacgacgtacagcatacgctaaactggtactgtcttgattactggagtgagcaactgg

SEQ ID NO: 605 - DNA, 100 bp, Artificial
  Synthetic
gagctgaatgccacgctcactctgcgccagggaaatgacgaacgcacggtgattgtaaaggcgattactgaacagcgtcgccccgccagcgaggcagcct

SEQ ID NO: 606 - DNA, 100 bp, Artificial
  Synthetic
gttggtctggaaggtgataccctggcggcctgcctggaagattactttatgcgttctgaacagctgccgacgcgcctgtttattcgcaccggcgacgtag

SEQ ID NO: 607 - DNA, 100 bp, Artificial
  Synthetic
catggcgatctggaagcagctaaaacgctgatcctgtctcacctgcggtttgttgttcatattgctcgtaattatgcgggctatggcctgccacaggcgg

SEQ ID NO: 608 - DNA, 100 bp, Artificial
  Synthetic
cagaagagatctaccgtttaagcgaccaaccagtgcttagcgtgcagcggcgggctaaatatctgctgctggagctgcctgagggctggattatcattca

SEQ ID NO: 609 - DNA, 100 bp, Artificial
  Synthetic
ttcccgccgtacaacattgagaaaagcgacgataaccactaccgcattacccttgcgctggcaggtttccgtcaggaagatttagagattcaactggaag

SEQ ID NO: 610 - DNA, 100 bp, Artificial
  Synthetic
gcggctaccctccgtataacgttgaactggtagacgaaaaccattaccgcattgctatcgctgtggctggttttgctgagagcgaactggaaattaccgc

SEQ ID NO: 611 - DNA, 100 bp, Artificial
  Synthetic
ggatcattaccggggcgcgtattgatgtcagcccgaagcagctcggttatgacgtaggctgctttatcggcattatattaaagagcgccaaagactaccc

SEQ ID NO: 612 - DNA, 100 bp, Artificial; identical to SEQ ID NO: 507
  Synthetic

SEQ ID NO: 613 - DNA, 100 bp, Artificial
  Synthetic
ccgctgcggcgacgttgcatcagacgcaatccgccctgtctcaccagtttagcgatctggaacaacgccttggcttccggctatttgtgcgtaagagcca

SEQ ID NO: 614 - DNA, 100 bp, Artificial
  Synthetic
gcgggctttgcgggcggtactgcggatgcttttacgctgttcgaactgtttgaacgtaaactggaaatgcatcagggccatctggtcaaagccgccgttg

SEQ ID NO: 615 - DNA, 100 bp, Artificial
  Synthetic
ggaactccatcgatcgccttagcagcctgaaaccgaagtttgtatcggtgacctatggcgcgaactccggcgagcgcgaccgtacgcacagcattattaa

SEQ ID NO: 616 - DNA, 100 bp, Artificial; identical to SEQ ID NO: 513
  Synthetic

SEQ ID NO: 617 - DNA, 100 bp, Artificial; identical to SEQ ID NO: 514
  Synthetic

SEQ ID NO: 618 - DNA, 100 bp, Artificial; identical to SEQ ID NO: 520
  Synthetic

SEQ ID NO: 619 - DNA, 100 bp, Artificial
  Synthetic
gcggcgctgtccgtcgggatgctggcgggcatggatttgatgtcgctgctgcacaccatgaaagcgggcttcggcaacacgctgggggaactggctatca

SEQ ID NO: 620 - DNA, 100 bp, Artificial
  Synthetic
ggtccgcgtatttacttcacccatctgcgctccaccatgcgtgaagataacccgaaaaccttccacgaagcggcgcacctgaacggtgacgttgatatgt

SEQ ID NO: 621 - DNA, 100 bp, Artificial
  Synthetic
gagccatatgttcgacggcataagtttaaccgaacatcagcgtcagcagatgcgagatcttatgcaacaggcccggcacgaacagcctcctgttaatgtt

SEQ ID NO: 622 - DNA, 100 bp, Artificial
  Synthetic
ccgatatcagcatactaaagggcagataaaggataatgcgatagaagcattactacatgatcccttattccgacagcgcgtagagaaaaataagaagggg

SEQ ID NO: 623 - DNA, 100 bp, Artificial
  Synthetic
ggaccaatatttaagtcatgctgtcgggaaaaccaatcagcgagtttacttccttgatgaaacagggcgcagctatgccttgccaattagtaacttacct

SEQ ID NO: 624 - DNA, 100 bp, Artificial
  Synthetic
gattttgcactataacccttcgcaagaatattgggccgatagtgtcgacccactctggaaacagcgctatgacttaggggtaaaagagcgttttatagcg

SEQ ID NO: 625 - DNA, 100 bp, Artificial
  Synthetic
acgaataaggcagatccattacgtttacaacttgatgctagcgaaggtgttgtttttacccttgatcctaaaggtgaagttgctgcataccgtggtaaac

SEQ ID NO: 626 - DNA, 100 bp, Artificial
  Synthetic
tcctgacacggttacttgatgaagtgcatcaacaattaccgaagattcagttgcatttacatgaagctcaaagtgagaagattgtagagcgcctagaaca

SEQ ID NO: 627 - DNA, 100 bp, Artificial
  Synthetic
gctaatgcagctggttatggggtaattgatctagctaaagttgttgaaagtagtacttatttgaaacagcaaaatgcaagcttaaaccagtcagtgaaac

SEQ ID NO: 628 - DNA, 100 bp, Artificial
  Synthetic
taagcaagctcaagtcattggtaatccgggttgttacccaacgactgttcaactgggcttggctccacttttaaaatcagcacaagcattgattgaaaca

SEQ ID NO: 629 - DNA, 100 bp, Artificial
  Synthetic
cagctgcggtgaatgatgctgtgcgtcaagctgaagtagtttctgaagaaaaaatgcaaaaagctaactctggtatgggtttacctcctggtttagcagg

SEQ ID NO: 630 - DNA, 100 bp, Artificial
  Synthetic
gtagatgttaatgaagtggctgcggaaagccagcgaaaagcagcattaagtgaacatgacaacttagaaccggggtcaaatttatggattgctcgtcagg

SEQ ID NO: 631 - DNA, 100 bp, Artificial
  Synthetic
taccacgtaatcttaaactttcggctgaagatgtttgggatggcgtgaactatattttatcgcttaagttccaagaaccacagttctctggtcaaaccaa

SEQ ID NO: 632 - DNA, 100 bp, Artificial
  Synthetic
gaccagtcaactcgttgcagacagcttatctgagcttgaacctgccaatacggtctctttagctctgattgccaatcgctatgcgaccaatccaagtgtg

SEQ ID NO: 633 - DNA, 100 bp, Artificial
  Synthetic
ttgtgtctggcggaccaatggaagcaggtaaggttaaattccgcggtgatgaaaaagcaattgaccttgtagatgctatggttgttgcagctgatgacag

SEQ ID NO: 634 - DNA, 100 bp, Artificial
  Synthetic
ctcatgaacttaatggacttgatcccagttgactggattcctcaagttgctgcatttgtgggtgctaacgtatttggtatggaccctcaccacgtttact

SEQ ID NO: 635 - DNA, 100 bp, Artificial
  Synthetic
agaagctgttgctcgtcaaccagaattagctccacaacttcaaactcgtatgttcttaatcgcgggtcttcttgatgctgtgcctatgatcggtgttggt

SEQ ID NO: 636 - DNA, 100 bp, Artificial
  Synthetic
tcgaacaagcgaaccgtcgtgcagcgcaattgatcgaagaagctcgtactcaagctgcggctgaaggtgagcgtattcgtcaacaggctaaagaagctgt

SEQ ID NO: 637 - DNA, 100 bp, Artificial
  Synthetic
cagcacagtaactgtttcagttgaagttaaacctgagcttattgcaggtgttgtaattcgtgcaggcgatcaagtgatagatgattctgcgcttaacaag

SEQ ID NO: 638 - DNA, 100 bp, Artificial
  Synthetic
aagtagcaccaggtgtaatttggcgtcaatctgtagaccaacctgttcaaactggttataaatcagttgataccatgattcctgtgggtcgtggtcagcg

SEQ ID NO: 639 - DNA, 100 bp, Artificial
  Synthetic
cacgtatggtcgcaatgaaagcagcgacagataacgcaggtcagcttatcaaagacttacaactcatctataacaagctgcgtcaagccgcgattactca

SEQ ID NO: 640 - DNA, 100 bp, Artificial
  Synthetic
actaaatctggttcgatcacttcgatccaagcagtatatgtacctgccgatgacttaacagacccatcgcctgcaactacatttgctcacttagacgcaa

SEQ ID NO: 641 - DNA, 100 bp, Artificial
  Synthetic
aacctcatgttgtgacggttcttgcagatactgcaatccgtgctgacaatttggatgaagctgcaattttagaagcacgtaaaaatgctgaacaattgct

SEQ ID NO: 642 - DNA, 100 bp, Artificial
  Synthetic
agcatttattgctggtgttgaccgtatcatggatatggctcgtactgcgttgaacgttgtaggtaacgcgcttgctgtacttgtaatcagtaaatgggaa

SEQ ID NO: 643 - DNA, 100 bp, Artificial
  Synthetic
taaccatattcaacatgatgatgccgattatgtgggggcagtaaaagaaaatatgatggggattattagagaaaaagaaaagaagaaaggaaagaactgg

SEQ ID NO: 644 - DNA, 100 bp, Artificial
  Synthetic
tttactggtgcatccttccctcatgttagatgcaaacggacactacaatcatagccagcttatgctggtgatggtgggtatttccggaggcttcatttat

SEQ ID NO: 645 - DNA, 100 bp, Artificial
  Synthetic
caacatctaggagtaacttggttagttgccctaggttctaacatgtcagcgctctggattttagttgcgaatggctggatgcaaaaccctgtaggtgcag

SEQ ID NO: 646 - DNA, 100 bp, Artificial
  Synthetic
agccgtttcttcaatggtttccgtcgtgatgctcaccctatggcaatcatggttggtgtagtaggcgcattatctgctttctatcacaacaaccttgaca

SEQ ID NO: 647 - DNA, 100 bp, Artificial
  Synthetic
tttagaagaaactcctcctgatgaaagcctttgggaaggtgaatgtttcgtatttgatggacgtactgctgtaactcatggtgttgaagaaggtgcaaac

SEQ ID NO: 648 - DNA, 100 bp, Artificial
  Synthetic
tcaatagctgctatatgttgaatgaccaaggtaaagaagtaccaatcacaactgcaatgattcgttcagtatgtcatcagttacttaaccagtgccgcgc

SEQ ID NO: 649 - DNA, 100 bp, Artificial
  Synthetic
atcatgatgacgatcgttatgaccgtaacgatggacgtcgatatagtgagtgggaacgcaaacgttgggaagagcgtaaaagattatatgaacaacaacg

SEQ ID NO: 650 - DNA, 100 bp, Artificial
  Synthetic
tatggcaagctttgctgatcctccttttgaccgaggacatggcccgaaaggtcctaaaggcggacctcgtggtgaatggaatgatcgtgggcataaattt

SEQ ID NO: 651 - DNA, 100 bp, Artificial
  Synthetic
aagacttgatccgtgccaacatgaaagaaatcgcacaagtattgacggctgaacaaggtaaaactttggcagatgccgaaggtgatattcaacgtggtct

SEQ ID NO: 652 - DNA, 100 bp, Artificial
  Synthetic
ataacctgattttaggaatttcaatggctgcggtggccgaaggcatggcactcggtgtgaagctaggcatcgacccacaagcattggcaggtgtaattaa

SEQ ID NO: 653 - DNA, 100 bp, Artificial
  Synthetic
gggcaaactgaagtaggcatggtggtgtgtaatcatcatggtttaaaacatgaaattcatgctggttcagcaggttttccaagtccgggctatcgtgttg

SEQ ID NO: 654 - DNA, 100 bp, Artificial
  Synthetic
tgtgactcttgatatttcaagtgcatcacacccgttctacacaggtgaagtacgtcaagcaagtaatgaagggcgtgttgcaagctttaacaaacgcttc

SEQ ID NO: 655 - DNA, 100 bp, Artificial
  Synthetic
gctgatttaaccgcgaataaacaaggcttacggaccaactctagtgtttctacaggacattctttcgacttaaattcgggagatgacagcgcgaaaggtt

SEQ ID NO: 656 - DNA, 100 bp, Artificial
  Synthetic
gaatattatgctggtttcggtgactgaacgtacgcaagaaattggtgtgcgtatggctgtgggtgctcgacaaagtgatattttgcagcagttcctgatt

SEQ ID NO: 657 - DNA, 100 bp, Artificial
  Synthetic
tgaacaaaaacaacttattgaacaaggcaaagcaacactaagtgtagttcgcgttttacaagcagatggtacgactaaaccaacacaaattttggtaggt

SEQ ID NO: 658 - DNA, 100 bp, Artificial
  Synthetic
tgattaatggcacagatatgccacgctttttggtacagaacattgcccaagcccaagaaatgctagaagcagtcaatcaccctgccttaaaaatgcaata

SEQ ID NO: 659 - DNA, 100 bp, Artificial
  Synthetic
cgttctaagttgaaaaaaattatcgatgaagatagttatttgactgccgaacatgaattaagtccaatgacgattaatgtagataaggcaacgcaagaaa

SEQ ID NO: 660 - DNA, 100 bp, Artificial
  Synthetic
ctggtagaaggcactaaacaagctcaggttgaacttgataaagcacgtattgcttttgaaaaagctcagcgcgaaggcgatttggcagaagcagcacgtt

SEQ ID NO: 661 - DNA, 100 bp, Artificial
  Synthetic
acaggccaaaaactacgtaaccaccctcacctcaataaatattcgattccatttagtatggaagccgactcggtaaacagtgcaattttaagccctgagg

SEQ ID NO: 662 - DNA, 100 bp, Artificial
  Synthetic
taaagttcaatgaagaaacaggccactatgagtttggcgagattgactggcacgaatttaatgaagtgattgccggacgtggaccatgtaatcacgagcg

SEQ ID NO: 663 - DNA, 100 bp, Artificial
  Synthetic
agaacgtgagtttttaaacctcttgttgtgcgaacaacccaatggtgactttgcacaaacgattgtacgccaatggttgatggaccattaccatcttcat

SEQ ID NO: 664 - DNA, 100 bp, Artificial
  Synthetic
gccgagcaaattatggatttgaaagatcagttcaaagaacgctttcaacttatcaatattttttctcgtgagttcaacgatagtgaactaatgaacggtc

SEQ ID NO: 665 - DNA, 100 bp, Artificial
  Synthetic
tgcagtcaagtggttccgaccgaattaaccgttgaatatgcggttcaacttgcagccaaaattgccaaacaagcgcctttagcgattcgcgtgattaaac

SEQ ID NO: 666 - DNA, 100 bp, Artificial
  Synthetic
caggtttaacgctagatcagatggatgtgattgagctgaatgaagcattcgcagcccaatctttggcttgtatgcgtgaacttggtctaaaagatgacga

SEQ ID NO: 667 - DNA, 100 bp, Artificial
  Synthetic
agacaactatccgtttggtatgtttgccgtaccgcaagagcaaattgtgcgtttacatgcatcatctggtacaacgggtaaaccgactgtggtgggttat

SEQ ID NO: 668 - DNA, 100 bp, Artificial
  Synthetic
gagtatgtagcacagctccctaaaaatattgtaccgcttgccatgcaagttgcagcgatgcaacgtgatttaattgagttacaggatcagtcttctaccg

SEQ ID NO: 669 - DNA, 100 bp, Artificial
  Synthetic
attggttatgaaaactctgcaaaagtggcgaaaactgcttataaagagaataaaactttaaaacaagttgctgtagagctaggacttgttacagcagagc

SEQ ID NO: 670 - DNA, 100 bp, Artificial
  Synthetic
aattgcaagtgtgcttggcatgattgtcgggaatacgggcaagatggcacgggattggtcactcatgatgcaaactgaaattgcagagttgtttgagcca

SEQ ID NO: 671 - DNA, 100 bp, Artificial
  Synthetic
tttagccgagctagttaaaactacccatacccgctggttcagtgaaaaatttgactatcagcataatgtggttgcacagacaacgattcaaagtctcgca

SEQ ID NO: 672 - DNA, 100 bp, Artificial
  Synthetic
ccaaaggtacggttttgctttgggtgacttacttcatgggactcgtggttgtttacttgctaacaagttggttaccaacacttatgcgtgaaacaggtgc

SEQ ID NO: 673 - DNA, 100 bp, Artificial
  Synthetic
actaaagaagatttaaaagagctgatcttacacagttcactctatgcgggtttacctgctgcaaacgctgcaatgcatatggctgaagaagtctttaaag

SEQ ID NO: 674 - DNA, 100 bp, Artificial
  Synthetic
tctagaagtatggcaagccaatgcttctggtcgttaccgccatccaaacgataagtttattggtgcaatggaccctaactttggtgggtgtggtcgtacc

SEQ ID NO: 675 - DNA, 100 bp, Artificial
  Synthetic
tttgaagatgaagcagaggcaaatgctaacgatccaattctaaatagcattgaatgggcaccacgtcgccaaacacttattgcgaaacgttttgaagaaa

SEQ ID NO: 676 - DNA, 100 bp, Artificial
  Synthetic
tcgcgggaaaatttggcgtttatcccaagcatgggtgaagaagggctttgttgataatactgtacaggtcaaatttggtcgtatgggaatgtcagaggac

SEQ ID NO: 677 - DNA, 100 bp, Artificial
  Synthetic
attaggaacaggtattgcgattggcatgtgtatgtacaagaaaaagcaaaagaacagtaagagcttctctactgatagtgataccgactcattgattagt

SEQ ID NO: 678 - DNA, 100 bp, Artificial
  Synthetic
tattagtggttggatacacttctgctggttcattaacgttttatgtagagaccgtttattcaaaaacctatttaaccaacttagggatggacggaaaaac

SEQ ID NO: 679 - DNA, 100 bp, Artificial
  Synthetic
ggactagaacgtttaggtgtagaactcaatccacaaggttttgtggcaattgatgactattgtaaaaccaacgtagcagggctttatgccattggtgatg

SEQ ID NO: 680 - DNA, 100 bp, Artificial
  Synthetic
ggtggtagctttagcatttcaaatttaggaatgttaggcattaaacagttcgatgccattattaacccaccgcaaggtgcaattatggcattaggtgctt

SEQ ID NO: 681 - DNA, 100 bp, Artificial
  Synthetic
tccgttatatgtttggcggaaaagcaaaagcaccaatggttgtacgtggcatgattggcgcaggtttctctgcggcagctcagcattctcagtcaccata

SEQ ID NO: 682 - DNA, 100 bp, Artificial
  Synthetic
ttgccgatttagataaaggtatgctcggtgccaacgggattgtgggtggtgggcctcctttagcaattggtgcagcgttgacagcgaaaaccttaaagac

SEQ ID NO: 683 - DNA, 100 bp, Artificial
  Synthetic
ctatgccttatatggcgatcgaccagtgagtaccactacactaaaagctgagctctcacagcttcgaaacctgattcccgatgtgatcgagtcacgacca

SEQ ID NO: 684 - DNA, 100 bp, Artificial
  Synthetic
gtgactgatgaaatcaaactgttaaatgaagaagacggtattgcgccaggtgtagaaattcgccaccgtaatgaacttgacgcagttcaacgtgagctgc

SEQ ID NO: 685 - DNA, 100 bp, Artificial
  Synthetic
atgacgccttaggtaaagtgaaattaccaaataaaaaagtgcaggcactgatcaatgccaaaaaacttggacaaaatgatgagaccttgccgtgccctgt

SEQ ID NO: 686 - DNA, 100 bp, Artificial
  Synthetic
atctgcaattggcggtggtttaggtggcggtgcaggttatactgttggtaaaagcatgggtggtacaaacggtggttacatcggtgctgctttaggtgca

SEQ ID NO: 687 - DNA, 100 bp, Artificial
  Synthetic
gcgaccgtcgtaaccgtacagaagcggctattggtggtgctttaggcggtggcgcgggttacaccgttggtaaaaacatgggcggtacaaatggcggata

SEQ ID NO: 688 - DNA, 100 bp, Artificial
  Synthetic
cggcattaacttggtaaatgtccgcttttttggggaatcggagttcttattttcctgcattaaaattgttgcgattttaagtatgattggcttcggtgct

SEQ ID NO: 689 - DNA, 100 bp, Artificial
  Synthetic
ttgcccaaactcgtttaactcctgcaaatgcagcttctgaaattgaccgcgtattgcgtcagtgtttccttgaacgccgtcctgtacacatccaactacc

SEQ ID NO: 690 - DNA, 100 bp, Artificial
  Synthetic
tgtggttggtgctggtgagattggtgaagcattatcttctcatccagatgtgcaaaaagtcgtgtttacgggatcaactcgaacagggcagcacattatg

SEQ ID NO: 691 - DNA, 100 bp, Artificial
  Synthetic
aatacccacaagtgaaagtggaaactggtgcccaaagcacttatccaatttatgacaatgacagtaataaattaaaagaatggcgtggccgcgcggaaat

SEQ ID NO: 692 - DNA, 100 bp, Artificial
  Synthetic
ggctatcctgccgcaggtttgggtatttctttatcttcgggtgcaaatgcaattcagacctctaagctcatccaccaaactctagatcagcttacaacga

SEQ ID NO: 693 - DNA, 100 bp, Artificial
  Synthetic
ttacatcagcatgaagaatcacgacgtcaatgggttgcagatacctctcatgaattgaaaactccattggctgttttgcaagcgcagattgaagcgatgc

SEQ ID NO: 694 - DNA, 100 bp, Artificial
  Synthetic
tgggaacaacaccgtgcagagcgtaaagctcgttttgagcaaattcaaaaagcatgtgaaggtaaagctgttggacaaactgtcaatgttcaagttggag

SEQ ID NO: 695 - DNA, 100 bp, Artificial
  Synthetic
acttgcttctgcctctatttttgcacaaagtgcgggcgttaatgcaggtgcatctgctcaagtcaacgtacaaccaggtggtcttgttagtggcgtagcc

SEQ ID NO: 696 - DNA, 100 bp, Artificial
  Synthetic
ggtttaattggcggaatgccagtgacctcagtgattgtccgtagttctgtaaatgccaatacaggtgcacgtagtaaatgctcaaccattattcacggtg

SEQ ID NO: 697 - DNA, 100 bp, Artificial
  Synthetic
aaagcttatctaaagtaaaagtgactacaaccgtcaacggccaaccaggttctattagcgatttggtcaatagcggacaagtacagcaagtttctgctgc

SEQ ID NO: 698 - DNA, 100 bp, Artificial
  Synthetic
cggcacaaaagacactcaatatggcgtaggcgttgagtacttcgttcctaactctgacttttaccttagcggtgatgtaggcagaaacgaacgtgaaatc

SEQ ID NO: 699 - DNA, 100 bp, Artificial
  Synthetic
ctaaacggaacggtatggaaaacgattgatgaccaaaccaataagcccaaagccgtagtaaaatttacggaacagaaggatggaaccttaactgcaacca

SEQ ID NO: 700 - DNA, 100 bp, Artificial
  Synthetic
tcagtgattgctgaattggggttgcctgtcattatcaagcctgtacatgaaggttcaagtgtaggcatgagtaaagttgagaaagctgaagattttgcgg

SEQ ID NO: 701 - DNA, 100 bp, Artificial
  Synthetic
atggtgtctgtcttgtcgatattggtgcaggtattaccaatctggcagtttatttagatggccgtttggctttagcacgcaccttacagcgtggaggtga

SEQ ID NO: 702 - DNA, 100 bp, Artificial
  Synthetic
attggtttgaccaatagtgaaggtcaaggtatcgaaggcttggaaatgcagttgaataagcaactgtcaggtgtagacggtgagcaaaaaattattcgcg

SEQ ID NO: 703 - DNA, 100 bp, Artificial
  Synthetic
tttggcttgaagaaaatatggatggcctagttgcaagagatgctgaccttttagcagaggctgtttatcgttcatgtgctcacaaagcccgcattgttgc

SEQ ID NO: 704 - DNA, 100 bp, Artificial
  Synthetic
tatttgctgaaggaagctatgttcgtgaaggtcaggcgctttatgagctcgactctagaacgaaccgtgcaacgttagaaaatgcaaaagcatcactcct

SEQ ID NO: 705 - DNA, 100 bp, Artificial
  Synthetic
tgacaggagttgcaccttttacccaattgcaaggtatgttaactgctcaagggcaagtggcaggtattatggtgacgggtattgaccctaaatatgaaaa

SEQ ID NO: 706 - DNA, 100 bp, Artificial
  Synthetic
tcattggcttagtaaaatctggaaaaccgcttgatatggtggatgtccaaattgggaataaccattataaagtgaagccagatgaagtggggtattggaa

SEQ ID NO: 707 - DNA, 100 bp, Artificial
  Synthetic
ccagtttccacgaatgcttgtaagcgcagaaactattgaagaaaaagctggtgcacttaatcttaaaactgaacaaccacccaagttgccagtcgatccg

SEQ ID NO: 708 - DNA, 100 bp, Artificial
  Synthetic
tgtgaaagtcgttatattagggcaagatccatatcatggtccaaatcaggcaaatggcttaagtttctcggttcaaagaggggttgcattaccaccatct

SEQ ID NO: 709 - DNA, 100 bp, Artificial
  Synthetic
ctgggcgcggtgttacgcgcggaacaaaactatatgtaaaagatgttccagttctagcagttccctactttaacttcccgatcgatgaccgccgtactac

SEQ ID NO: 710 - DNA, 100 bp, Artificial
  Synthetic
cgtgaaattcaaacgatcactgctaaaggtagaccgtctaagtttcagcaacaaataagtgctgataaaggtattgcacgcggtgaaggacaaacgattg

SEQ ID NO: 711 - DNA, 100 bp, Artificial
  Synthetic
gcacatgaacaaaccttaatgcgttatgaacaccgccgtaaaggacaaaatgatgcgatgatgcatagtatgtcggcaattggttggctagaaagcagtg

SEQ ID NO: 712 - DNA, 100 bp, Artificial
  Synthetic
agcgcctcaaccattaggccgtttattaccttcacacattgcttcagcattccagcagaatcttgaagaagcgggtgttaaatttgccttaggcacaacc

SEQ ID NO: 713 - DNA, 100 bp, Artificial
  Synthetic
tggtaaagaagtgacggcggtaattgaattacgtgcccgtttcgatgaagagtcgaatatcgaagtggctaacgttttacaagaagcaggggcagtcgtt

SEQ ID NO: 714 - DNA, 100 bp, Artificial
  Synthetic
tgtgcagttggctagagaacaacttgctcagcgtcagcttatgcctgttttacaatgggtgattattgttgtagcaattgcagtttgggctgtgccggaa

SEQ ID NO: 715 - DNA, 100 bp, Artificial
  Synthetic
attgatggtttagacaatgttgagctacatattgcgcagtgttgccaaccagttcatggtgaatcaattgccggttatatcacgttgaaccgtggggtaa

SEQ ID NO: 716 - DNA, 100 bp, Artificial
  Synthetic
tatggtccagatttcccgttagtaacggtccgtgactgggtcaaaactcaagccatgctttctgaccgcttaggaataagtgtctggtatgcggtggtcg

SEQ ID NO: 717 - DNA, 100 bp, Artificial
  Synthetic
tgaagagcatatggcggcaaaaggacaagtttctccggaagtttctgttttgcagcaattggcaaaagatggcttcgttgcagaattaaaacgtgcttac

SEQ ID NO: 718 - DNA, 100 bp, Artificial
  Synthetic
caagactaccgccaaatcattttaaatgagctggacttgagtattgaggcagataacacccgtcgtatgcgccattacttcactggttcaaccatgatgt

SEQ ID NO: 719 - DNA, 100 bp, Artificial
  Synthetic
gatttaagcgatcaaggtatgccaagtattgcggagcgtgcagcagaaactgaagtgagtcgtgatggaatgcctcagcgagtttctgtgccaaaaccag

SEQ ID NO: 720 - DNA, 100 bp, Artificial
  Synthetic
aaatactttggtgtggcggcacaggggcgactagatgccagtatcttgtttagcatcattggatatcgtttacctgaatttctaaccctcattttaccac

SEQ ID NO: 721 - DNA, 100 bp, Artificial
  Synthetic
acactgctggcgtcataagactccgattattttccgtgctacaccacaatggtttatcagcatggatcaaaaaggtttacgtgacggtgcgcttaatgcc

SEQ ID NO: 722 - DNA, 100 bp, Artificial
  Synthetic
catgttagtgctttatgtgggctttatgctacttgtgggctacaacaaagaatttttgatgagttcctttagtggtggtgtaacgacatgggggatcccg

SEQ ID NO: 723 - DNA, 100 bp, Artificial
  Synthetic
tgctgcaaaaattatgggaccaggtaaacttgccgcaaacccgattgatgccttatctcttggcttagcactcatgtttggtacagcaggtcttccacac

SEQ ID NO: 724 - DNA, 100 bp, Artificial
  Synthetic
taaatcacgccacttaaccatgatctcgattgcaggggttattggtggctctctctttgttggctcaggcagtattatctacaacaccggccctgtagtt

SEQ ID NO: 725 - DNA, 100 bp, Artificial
  Synthetic
gcgaacctcttcttgactcacggttttaaaaaggaaaatatttacgttattggacgtggttcaactcaaccgtatgtaccgaatacaaccaatgaaaatc

SEQ ID NO: 726 - DNA, 100 bp, Artificial
  Synthetic
tttcagctgagcttaactatgctcagccagcaaatcaggcagaagttattcaggctctcgacaaagctggttttaaagatgctgtagtacaaactttagg

SEQ ID NO: 727 - DNA, 100 bp, Artificial
  Synthetic
tgaccaaaagcgtgagtcggttaaagcactacatggtttgaatttccgtgtgattgcagcaggtgattcatataatgatacaacgatgcttggtgaagcc

SEQ ID NO: 728 - DNA, 100 bp, Artificial
  Synthetic
gtggagcaattggtaccggattatttttaggctcggcgcaagtgattcaatctgcgggaccatccattattttaggatatgccattggtggcttaattgc

SEQ ID NO: 729 - DNA, 100 bp, Artificial
  Synthetic
ggcaggtacaaacttatgtccaagcgggttcaaatttagataaaggctggcgtgtgggagtagggccgacattaggatgtatgaatcagtggcttgaaaa

SEQ ID NO: 730 - DNA, 100 bp, Artificial
  Synthetic
aagtttagccaaactggcatggcatcgtggtatggtcgtcaatttcatggccgtaaaactgcaagtggtgaaacattcgatatgaatgcacttactgctg

SEQ ID NO: 731 - DNA, 100 bp, Artificial
  Synthetic
tgatggcaattgtatggcttggaacagtggttacaggcattagtacaatcttaggttacaccacgctgatatttggtttagtggttacagcaattctgtt

SEQ ID NO: 732 - DNA, 100 bp, Artificial
  Synthetic
tgtattcgtgctcaagaaggcggcatctctgaaattgatgaagataccattgcctaccatttccatgaaccactaggtgtggttggtcaaatcattccat

SEQ ID NO: 733 - DNA, 100 bp, Artificial
  Synthetic
tgtccacaacggtgtgaatgcctataacgaaaatggctgtgactttattgtgtcgttaggcggtggctcatctcatgactgtgcaaaagggattggctta

SEQ ID NO: 734 - DNA, 100 bp, Artificial; identical to SEQ ID NO: 644
  Synthetic

SEQ ID NO: 735 - DNA, 100 bp, Artificial
  Synthetic
ttgtcagcctttctatgttgtgtgctcatggcggcgcttggcttatgctacgcacagacggtgccttgaaacaacgctctgctaaagcaactcaaattat

SEQ ID NO: 736 - DNA, 100 bp, Artificial; identical to SEQ ID NO: 645
  Synthetic

SEQ ID NO: 737 - DNA, 100 bp, Artificial
  Synthetic
acggcgaaccctgaacactgtaaagctttggttgaaaattcaattggtattgtgactgcacttaacccatacctaggttatgaaactacaactcgtattg

SEQ ID NO: 738 - DNA, 100 bp, Artificial
  Synthetic
aaacgcgcagctgacctcatggaaagccgtattcaagagttgatggtattactttgccgtgaaagtggtaaaacttatgccaatgcgattgcagaagttc

SEQ ID NO: 739 - DNA, 100 bp, Artificial
  Synthetic
gtctcacttgccatcggtatgggtttagcaaactttttccaacctggcgcggcgctagacctagcattaccaacagctcaacaacttagtagttcttctc

SEQ ID NO: 740 - DNA, 100 bp, Artificial
  Synthetic
ggcagccatgctccctctttatcaacgcctcggtatgaatacactgatcatgacagcacttatgttgttatgtagtggtgtaatgaatctgaccccatgg

SEQ ID NO: 741 - DNA, 100 bp, Artificial
  Synthetic
gcagtagcgttaatgtctagcccatataacaacgtagatgaagcgcaaagccttgcagactaccgtggtttgttctggcgccgtccagtacttacagcaa

SEQ ID NO: 742 - DNA, 100 bp, Artificial
  Synthetic
ttgcagtgaagttaccagttttcccattgcatggctggttaccggatgcccatgctcaagcacctacagcgggttctgtagacttggcgggtatcttgat

SEQ ID NO: 743 - DNA, 100 bp, Artificial
  Synthetic
aggtgaagaccttgtcaaaaaatttgctgtgaatggtgtgtaccgttggttttgtagcgaatgtggttcaccgcttattagctcgcgtgatgctcagcct

SEQ ID NO: 744 - DNA, 100 bp, Artificial
  Synthetic
ggcttagcagtgctgggctatgcggttaacttatttttgtttgcgatgggtcgtttgcaagtcagctcaccagccatcctaaccgaaaccaccaatatta

SEQ ID NO: 745 - DNA, 100 bp, Artificial
  Synthetic
ttaaagattgcaccgagaattaaacaagaaaaagcagccatgctgacttatttcctgattgccatgatgctcgcaggcttaccaccttttagtggcttct

SEQ ID NO: 746 - DNA, 100 bp, Artificial
  Synthetic
gagcgtggtgatattttggtccactctcttagcacagaaaatactgaaagtgatgtgcaagacatcaaacaacgctatgaggctccactcatggaaattt

SEQ ID NO: 747 - DNA, 100 bp, Artificial
  Synthetic
cagaacggacagctacaagtggacatccgtgatcagcgtaatcaaaaaatggccaatcttttactagatgccaatatgatgctggatgttcagctcacac

SEQ ID NO: 748 - DNA, 100 bp, Artificial
  Synthetic
atgaaaccggatattagtgaattatctgttgaagagttaaaacgcttacaagaagaagcagaagctttaattgcaagcaaaaaagatcaagcaatcgaag

SEQ ID NO: 749 - DNA, 100 bp, Artificial
  Synthetic
tgttctacatcgaccaaaacacaatcgactacttacgcctaacaggccgtgaagatgctcaagtggcattggttgaacagtacgcaaaagaaattggcct

SEQ ID NO: 750 - DNA, 100 bp, Artificial
  Synthetic
tgtaccgtaggacgtagcggtaacgacttgcactatcgtggctatgacattcttgaccttgcggcaggtagcgagtttgaagaagttgctcacttgctcg

SEQ ID NO: 751 - DNA, 100 bp, Artificial
  Synthetic
ttaccactgaagagttagcatctgccgatgtaagccttgcgctttatccgctttctgctttccgtgccatgaacaaggcagccgaaactgtgtatgaaac

SEQ ID NO: 752 - DNA, 100 bp, Artificial
  Synthetic
gtatcaagtgaggtaaaaccagcggtagagcaagcaatgaacaaagagttctctgcttacttacttgagaatccacaagctgcaaaatcaattgcaggca

SEQ ID NO: 753 - DNA, 100 bp, Artificial
  Synthetic
ggcttggttttatgcttgcagggatgtttttttgggggctattggaagtggtccgttttggagttcaagtcacttttgaaatgccagtcacatatagtta

SEQ ID NO: 754 - DNA, 100 bp, Artificial
  Synthetic
ttgccagatttaaatagatctccggaacaggtagtagcacaggtttcagagctgattgagtctttacaagaggtggctttagtcggcagtagtcttggtg

SEQ ID NO: 755 - DNA, 100 bp, Artificial
  Synthetic
gagttacgtaatttattaccacgtaatcttaaactttcggctgaagatgtttgggatggcgtgaactatattttatcgcttaagttccaagaaccacagt

SEQ ID NO: 756 - DNA, 100 bp, Artificial
  Synthetic
aaccatcccacttggcattatgacttgtgtcacgggtgtttcaggttcaggtaaatcaacactgattaaccgtacgttactcccactggctgcaacacag

SEQ ID NO: 757 - DNA, 100 bp, Artificial
  Synthetic
gacgacggttcaatccagcactttgaaggctaccgtgtacaacacaacttgtctcgtggtcctggtaaaggtggtgttcgttaccatccaaatgttgact

SEQ ID NO: 758 - DNA, 100 bp, Artificial
  Synthetic
ctaaaaacaattccgggtgcatcgcctgaactgatccatgaagcaggtttatatgctgaccggatgagtattaatttagagatgccgactgagattgggt

SEQ ID NO: 759 - DNA, 100 bp, Artificial
  Synthetic
agtctggttcgtcctgattttaatgtcttaccactcattcagccgcattttaaacggcgttatcaagatcagcgttggctcatttatgatgagcaacgta

SEQ ID NO: 760 - DNA, 100 bp, Artificial
  Synthetic
ctttggcacaaggaacttctagcgctgcggccctgcctcagattcaatttgtttcgaactcacctgttgcagaagcagaagcagccttacagtcactagg

SEQ ID NO: 761 - DNA, 100 bp, Artificial
  Synthetic
acatggcaacaaaaaatttcggcattgcgtggccgtgttatgaagcgtctggttgatgaagtcactacagcttttgccaaacatcattatgaaattatta

SEQ ID NO: 762 - DNA, 100 bp, Artificial
  Synthetic
gctttggtgaaattgccatttccaatgccgaatgaaagtaaccaagcaggcgatgctgtacacaaccaagtacgtccgaaacctgaacaatatgcagata

SEQ ID NO: 763 - DNA, 100 bp, Artificial
  Synthetic
atatttgtacaacctgtatggaaagcatggcgaaaaatcgaacctcgtttaaacttttactcggttaaacgttgtatgtactgtggttcaaatgatctaa

SEQ ID NO: 764 - DNA, 100 bp, Artificial
  Synthetic
catcaccttagatccattaattatggaagacctcatgcaacagacatcagtcaaagaggtatggggaatcggctatcaattagtcaaacagctacaaagt

SEQ ID NO: 765 - DNA, 100 bp, Artificial
  Synthetic
tctcagcagcgccctcctcttactggccaacgtttacgctcatatgcttttgctttactcactcgccgagattactctaaagcagagcttatcgagaaat

SEQ ID NO: 766 - DNA, 100 bp, Artificial
  Synthetic
ctaaagcagaaatcgaaggtgagatgggtgactctcatatgggtctacaagcacgtcttatgagccaggcacttcgtaaaattacgggtaatgctaaacg

SEQ ID NO: 767 - DNA, 100 bp, Artificial
  Synthetic
aaaacatacttataacgcccgtcatgaaacaattttccaaaaaccgagttttcaagaagctgctcttaaatgtaagttcggtgtaatacccgtgacggag

SEQ ID NO: 768 - DNA, 100 bp, Artificial
  Synthetic
acaacgataaaatttaccacattcctttggcgacagaacgtgttgctgcgggtttcccatcaccagcgcaagacgatattgagcaagcactcgatttaaa

SEQ ID NO: 769 - DNA, 100 bp, Artificial
  Synthetic
gggtcgccagtaattatcattcacgccgtggagaggtcgatctgattgtaaaacgcggtaacgaattgatttttgttgaggtaaaagcgcgagggcaggg

SEQ ID NO: 770 - DNA, 100 bp, Artificial
  Synthetic
acatgaaatcgcgcttgatattcaagaaggcgccgacatggtgattgtaaaaccgggcatgccatatctggatgtggtacgtgaagtgaaagataccttt

SEQ ID NO: 771 - DNA, 100 bp, Artificial
  Synthetic
ttatgacatttatggtgcaatgcgtgacaacgcgatgctctctaaatgggcaggtggtttaggtaatgactggacacctgtacgtgccttgaactcttat

SEQ ID NO: 772 - DNA, 100 bp, Artificial
  Synthetic
ttaaatatgagtgggcttggcaaaaatatctagatggttgtgcaaaccactggatgcctcaagaagtgaacatgaaccacgatatcgcactttggaagtc

SEQ ID NO: 773 - DNA, 100 bp, Artificial
  Synthetic
atgactaaaccaccatatcatgatgatcaagcgtcattttccgcacccattgaagatttgcaagtgcgaattgcatttttagatgatttagttgaggaat

SEQ ID NO: 774 - DNA, 100 bp, Artificial
  Synthetic
aactaccgtgctggggaccaatatttaagtcatgctgtcgggaaaaccaatcagcgagtttacttccttgatgaaacagggcgcagctatgccttgccaa

SEQ ID NO: 775 - DNA, 100 bp, Artificial
  Synthetic
gctaggtggttgtgccaaaaaagaggagcacaccacaacaactttaaatatcggctatcagaaatatggcatccttcctattctaaaagcacgtggtgac

SEQ ID NO: 776 - DNA, 100 bp, Artificial
  Synthetic
aatttccaaatgccaaaatcacttggaatgagttccccgctggccctcaaattttagaagccttagctgttggctcactcgatgttggcgttactggaga

SEQ ID NO: 777 - DNA, 100 bp, Artificial
  Synthetic
cagtatttcccgaatgtacagatcattgctacgccggaaacagtaaagcatattcaggatactcaagcgcttaaagttaaatattgggggccacaaatgg

SEQ ID NO: 778 - DNA, 100 bp, Artificial
  Synthetic
cccaactgaaatccagtttcaagacaaaacatatgcaagcgaaattgcccagttctttgttcaggaactcttaaaacacggtacaaccacggccctcgtt

SEQ ID NO: 779 - DNA, 100 bp, Artificial
  Synthetic
catggcagacttatgccgtacgattaccaaaccacatgaactcgactttatgacagtgtctagctatggcggcggtaccacttcaagtcgagacgttaaa

SEQ ID NO: 780 - DNA, 100 bp, Artificial
  Synthetic
tgtatgctagatgacaatgaagaacgtattcgtctagctcaatatggcacttctaatattggccgtttcaagacgctttatcgccgtggtttaggtattc

SEQ ID NO: 781 - DNA, 100 bp, Artificial
  Synthetic
gcctaaagcagtttctcaatatgatgagaactatggccaaagccaagtttattaccatcaagtcaacttccagattaaaaccaagccttcagagcactac

SEQ ID NO: 782 - DNA, 100 bp, Artificial
  Synthetic
tatatctatattcatggtacacctgataaagaaccgatgggggttccaatgtcacatgggtgtattcgaatgcgtaatgaagaaatcattgaattgtttg

SEQ ID NO: 783 - DNA, 100 bp, Artificial
  Synthetic
aggaattggtttaactggaccaaatgctatggctctagccatgtcaaagcaaggtgctcgtgcaggaacagccagtgcaattatgggcagtatgcaattt

SEQ ID NO: 784 - DNA, 100 bp, Artificial
  Synthetic
gggcatctttagagactcgccgtaaagacttgcaatcaaaaactgaaaagttacaggcagagcgaaatgccggtgctaaacaagtgggtcagattaaaaa

SEQ ID NO: 785 - DNA, 100 bp, Artificial; identical to SEQ ID NO: 705
  Synthetic

SEQ ID NO: 786 - DNA, 100 bp, Artificial
  Synthetic
tcgtgtcacgatctgcaaacctcatggatgtacccattacagttgagggtgcagaagaagttgcacgccgttcacgcggaacaccgcgtattgccaatcg

SEQ ID NO: 787 - DNA, 100 bp, Artificial; identical to SEQ ID NO: 760
  Synthetic

SEQ ID NO: 788 - DNA, 100 bp, Artificial
  Synthetic
gtagaaaatgaggattgggaagaacaaagtacatctgctttgcatgacgcaatgaaccagctagatgaccgttcacgtaatattttgcagcgccgttggt

SEQ ID NO: 789 - DNA, 100 bp, Artificial
  Synthetic
ttactgttccaaacggacatgaggaagtgcgccgtcgtgcggatttggtaacacaggcgatgggtggccgtggagctgtgcgtgaagtttgtgatatgtt

SEQ ID NO: 790 - DNA, 100 bp, Artificial; identical to SEQ ID NO: 626
  Synthetic

SEQ ID NO: 791 - DNA, 100 bp, Artificial
  Synthetic
tgctttttatgcacaaagtaaattacttcatgatgctttagagcaagttcaatatggtgagttagctaaaagtcattggtatttcttgggtgttgcaggc

SEQ ID NO: 792 - DNA, 100 bp, Artificial
  Synthetic
aaactggtgacatgggtattggtaaagatggcgagcctacacataactttactccgggttatgaacttcacgctaaatacactctctttgctgaaggctg

SEQ ID NO: 793 - DNA, 100 bp, Artificial
  Synthetic
aagtgaccttaacgcgtgcagttgtagactcgcaaactattgctttaaacaaagagctacaacaacgtcacttagaaccaaaccgtaaagtattctactg

SEQ ID NO: 794 - DNA, 100 bp, Artificial
  Synthetic
gaattagagttatttgaagttaatcacgctgtacaaaacacccaaaaagagattgcaacacgttttgacttccgtggtcatgatgtttctatcgaattaa

SEQ ID NO: 795 - DNA, 100 bp, Artificial
  Synthetic
gatcactgttcagtttgctgacaatgcggatcgtgatgcagcaatggattttttacgccgtaatggtaatgaatatacccaacaggcattagcgagcacg

SEQ ID NO: 796 - DNA, 100 bp, Artificial
  Synthetic
ttcttgcaaagtattcgtgttatgaaaagcagccgtacagaaggcgaagatgagcatggccttacacctttccaagcgtttgtaactggtcttgcgagcc

SEQ ID NO: 797 - DNA, 100 bp, Artificial
  Synthetic
aatgcggcaacttctgataaagaggaaattcgaaagcttcgtcaagaagttgaagcattaaaagcattagttcaagaacaacgtcaagtacagcaacaac

SEQ ID NO: 798 - DNA, 100 bp, Artificial
  Synthetic
aaggtaacatcggttgtatggttaacggtgctggtcttgcaatggcaactatggacatcattaaactttatggtggtcagcctgcaaacttccttgacgt

SEQ ID NO: 799 - DNA, 100 bp, Artificial
  Synthetic
cagatgcttctggaaataccgaattagcgttagatgggggtaaaatccaaaaaggtttgtcttcaaatgccaaaactacattaaacatggatgctgaaac

SEQ ID NO: 800 - DNA, 100 bp, Artificial
  Synthetic
aacggtatcaaacaaggtaaccgtaatgctttactttacactgacccaagtgttgatggcttaaaaacaggccatactgatgaagctggttactgcttaa

SEQ ID NO: 801 - DNA, 100 bp, Artificial; identical to SEQ ID NO: 645
  Synthetic

SEQ ID NO: 802 - DNA, 100 bp, Artificial
  Synthetic
ggcgtgcgattattggctttgtagatggaacagaaaatcctgaacctgtaattgctgcacaatgggcattagtgggtaacgaagatcctgactttattgg

SEQ ID NO: 803 - DNA, 100 bp, Artificial
  Synthetic
tgaaagacgcaatcttccgtgagccaatcgatcagtctactaagctttatgtcaacttattgggtgttgctgaagcgaacaaaaatgacccgatctatac

SEQ ID NO: 804 - DNA, 100 bp, Artificial
  Synthetic
aaatggcgataacgttgtaaatccatcagctcatactccttggtacaaggggcaaaccttaatgagtattcttgagtctgtggaaatcaaccgcgagtca

SEQ ID NO: 805 - DNA, 100 bp, Artificial
  Synthetic
gcgccgtgacgaagaaaaatcacgtgcgaaagagcgtgtgtattcattccgtgatagtaaacatcgttgggatcctaaaaaccaacgtcctgaactttgg

SEQ ID NO: 806 - DNA, 100 bp, Artificial
  Synthetic
accatattcaacatgatgatgccgattatgtgggggcagtaaaagaaaatatgatggggattattagagaaaaagaaaagaagaaaggaaagaactggtt

SEQ ID NO: 807 - DNA, 100 bp, Artificial
  Synthetic
tttggtgcagtagcgttaatgtctagcccatataacaacgtagatgaagcgcaaagccttgcagactaccgtggtttgttctggcgccgtccagtactta

SEQ ID NO: 808 - DNA, 100 bp, Artificial
  Synthetic
gaagttaccagttttcccattgcatggctggttaccggatgcccatgctcaagcacctacagcgggttctgtagacttggcgggtatcttgattaaaaca

SEQ ID NO: 809 - DNA, 100 bp, Artificial
  Synthetic
taaatctgcacaaattccattgcaaacatggttagcagatgcgatggcaggtcctacacctgtttctgcattaatccacgcagcaacaatggtaacagct

SEQ ID NO: 810 - DNA, 100 bp, Artificial
  Synthetic
ctgcagcgttagcattcgttcttgcgggtagcgtatgggcacaaccagatggacaagtcatgttcattctgattttaacccttgctgcggcagaggcgtg

SEQ ID NO: 811 - DNA, 100 bp, Artificial
  Synthetic
ggaagagcgttgtgtggcatgtaacctttgtgcggttgcatgtccggttggctgtatttcactgcaaaaagctgaaaaagaagacggacgttggtatccg

SEQ ID NO: 812 - DNA, 100 bp, Artificial
  Synthetic
tgggtgttgcggacatgagcatcggtttgttgttctttatggcaatggctggtattgcggtttatgcagtgttattcggtggttggtcatcaaataacaa

SEQ ID NO: 813 - DNA, 100 bp, Artificial
  Synthetic
gtgaaactgaaactgtgaaacaggctgatattgtactttcagcagcaagctttgccgaaggtgatggtactgtcgtaagccaagaaggtcgtgcacaacg

SEQ ID NO: 814 - DNA, 100 bp, Artificial
  Synthetic
tttgctgagcaattcggttctaagcttgtgtttccatgtgatgttgccgttgatgctgaaattgataatgcatttgcggaacttgcaaaacattgggacg

SEQ ID NO: 815 - DNA, 100 bp, Artificial
  Synthetic
tgctggaaaggtaaatttgcgtcgcgtcaccattattcaacttggtgtcgcctctctactttcttttaccattatgcctatagtaggtgaacatacaatt

SEQ ID NO: 816 - DNA, 100 bp, Artificial
  Synthetic
gcaattgctttacttgcactgctgagttgggttggcttaaagaaacaaatgcctagtcataaggtgagtgtaaccaaacagccttttagttatctttttg

SEQ ID NO: 817 - DNA, 100 bp, Artificial
  Synthetic
taaaaagcatccgggtcttgtccgaatgcttcgtcagtttgaggcaacatggcaaaaacagttgggcactttaggcggcggtaatcactttatagagtta

SEQ ID NO: 818 - DNA, 100 bp, Artificial
  Synthetic
ttagagagagacggttttatcgaacgaaaaattcaggatacttcccctattcgtgtcgattattccctcacgccacttgggcaaaatgtagctgctatgg

SEQ ID NO: 819 - DNA, 100 bp, Artificial
  Synthetic
atgttagaccgcactccatctcgcgaactccgtgaagacctttgggtatttccaatggactatccaattaaactcattggcgatgcgggtgaagaattac

SEQ ID NO: 820 - DNA, 100 bp, Artificial
  Synthetic
aggtgatgatgattctgaaggtgattcaggtccagaccctgaagttgcaaaagttcgttttgctgaattagaagctgcatgggctcaaactaaagctgtc

SEQ ID NO: 821 - DNA, 100 bp, Artificial
  Synthetic
gcttaatgaatgtatgcagcaacatccgaatctgccgcttgaacttcaaactcacccgacaggatatttgttaaatgctgtgcaacaaggagaagtcgat

SEQ ID NO: 822 - DNA, 100 bp, Artificial
  Synthetic
gtggacatcaggaaacagaagatcagttcccgagagatgttgtagaaatcttgcaatatttcaaagcacctcaagtgggccaaaagattattgcgacacc

SEQ ID NO: 823 - DNA, 100 bp, Artificial
  Synthetic
agcaagcgaccgtcgtaaccgtacagaagcggctattggtggtgctttaggcggtggcgcgggttacaccgttggtaaaaacatgggcggtacaaatggc

SEQ ID NO: 824 - DNA, 100 bp, Artificial; identical to SEQ ID NO: 731
  Synthetic

SEQ ID NO: 825 - DNA, 100 bp, Artificial
  Synthetic
gggaaagaacgatctctgtgcggattttacatgcgattggttttgagggtggtttgctgattgcgactgttccaatgattgcatatatgatgcagatgac

SEQ ID NO: 826 - DNA, 100 bp, Artificial
  Synthetic
agtgcagcattgaatttaactgccaatcagcttttatggattattgatatttattcgctgattatggcgggtttgattttaccgatgggtgcactcggtg

SEQ ID NO: 827 - DNA, 100 bp, Artificial
  Synthetic
gcatcggcgatttatacatgcttattgcaattattttgtgtggatttggctatgcagaaggcggagtactttcgaaaaaaataggtggatggcaggtgat

SEQ ID NO: 828 - DNA, 100 bp, Artificial; identical to SEQ ID NO: 670
  Synthetic

SEQ ID NO: 829 - DNA, 100 bp, Artificial; identical to SEQ ID NO: 671
  Synthetic

SEQ ID NO: 830 - DNA, 100 bp, Artificial; identical to SEQ ID NO: 672
  Synthetic

SEQ ID NO: 831 - DNA, 100 bp, Artificial
  Synthetic
aggtgcgcttgccgaagttacacttaattttattgcccaagacccttctcaagccgagcgttaccgcaaatctggttttgaagcattttggcatgcagtt

SEQ ID NO: 832 - DNA, 100 bp, Artificial
  Synthetic
aatggggctatcggtcgaagctgggcttttagggccgttaggaaaggaagtaggtgagttgtgggccacttttagtatttttggtgtgggtgcagcactt

SEQ ID NO: 833 - DNA, 100 bp, Artificial
  Synthetic
actatgcaccatgttaaaacaggcgcattgtctattagccgcttggaatatggcgcagatgttattattgaaccagatcatcttgataacttttacttaa

SEQ ID NO: 834 - DNA, 100 bp, Artificial
  Synthetic
aaatcactcttgccaacctcattagccgagacaacgttcaaactgttgcattacgccaaaatgtaactggcacagattcagctcttttatcgggtacagg

SEQ ID NO: 835 - DNA, 100 bp, Artificial
  Synthetic
aatttgtagatgatatcgatgaacatgatcaaattttcgaacaattcggcgttaaggtttttgtagatcctaaaagcttagtttacttagacggcttaga

SEQ ID NO: 836 - DNA, 100 bp, Artificial
  Synthetic
agctcttaaaaagcaagatcatcatcttgatcaatctattagtgatttcgaatttctacaatccgctttagaacttcgtgaacaacttgatgaagcgaca

SEQ ID NO: 837 - DNA, 100 bp, Artificial
  Synthetic
tacttcatggcattccaccaatgactgcaggccaagctcgtattgaagtcactttccaagttgatgcagatggcttactcaccgtttctgctcgtgaagc

SEQ ID NO: 838 - DNA, 100 bp, Artificial
  Synthetic
agcttacctttagatgtattacgtattgcgattccactcacgatttactttgtagtgatgttctttattagtttctttatgagtaaacggatgaggaata

SEQ ID NO: 839 - DNA, 100 bp, Artificial
  Synthetic
gacggggccgacttaggttttttggcattaagcctcactagtcttaaagcagagtttcatttaactggtgtgcaagccggaacattaggaagcttgacac

SEQ ID NO: 840 - DNA, 100 bp, Artificial
  Synthetic
gcaggtgcagatctaaaagaaatggcaaccgcaacttccacagaaatgttattgcgtcatacagaacgttattggaacgcgattgcccagtgccctaaac

SEQ ID NO: 841 - DNA, 100 bp, Artificial
  Synthetic
ttaaagcaagcacaggcaggcgtgattataaatatgtcatctattgccggacgcttaggctatccatatcgattggcctattccacttcaaaatggggac

SEQ ID NO: 842 - DNA, 100 bp, Artificial
  Synthetic
gtggttgaagatgtggcaattaaacttgctcacaaaccaagccaagccttacagctcagtaaaaagttactaagagatatgccaattgatgatctactca

SEQ ID NO: 843 - DNA, 100 bp, Artificial
  Synthetic
cagatgacaggtttgccaaaaccaaccattactcgcctcacacataccttgtcgcgtttgggttatatcaaacaagtacctaactcaagcaaatttcagc

SEQ ID NO: 844 - DNA, 100 bp, Artificial
  Synthetic
ttcggtcttacaattcccgaagaatatggtggcttaggcatcactatggaagaggaagtcagagttgcatttgaacttggacaaacttcaccggcttttc

SEQ ID NO: 845 - DNA, 100 bp, Artificial
  Synthetic
ggtcaaacccttaaaaaagattatgcttctgttgcatcaaaatttaagttttctgaaaagcaattaggtaatgcttctgaaggttcaaattgtagtcagt

SEQ ID NO: 846 - DNA, 100 bp, Artificial
  Synthetic
caatgccaatggttcagttttgtatattgttaaagaggaaagtaagattccactggatgtagaaaagtttaaaactgaccgacctaaaatctatgatgcg

SEQ ID NO: 847 - DNA, 100 bp, Artificial
  Synthetic
tgaatactaaaatcacctatactgctttcactggaagcacgcttattgcgagtgactcccttgttgaacttgcaaagaaactaaaagctcttcctaaaac

SEQ ID NO: 848 - DNA, 100 bp, Artificial
  Synthetic
gcaggtttaatgtttggccttatgtttggggtaagtggtattgccgcagcggggctagggcatttagcggatattaacggcattgaatgggtatttggtt

SEQ ID NO: 849 - DNA, 100 bp, Artificial
  Synthetic
ctggtacgtcaactcaccattgggtggtgcatttgaatattacaccaacgatgattatttgaccgaagaatggcagccacgtgtagaagaacatcgtcta

SEQ ID NO: 850 - DNA, 100 bp, Artificial
  Synthetic
ttgaagcaaccgagtatgtgccacaggaacgtcatgatttatatgtcaacggaagagcgattcaacgccagcaacttccacaagatttaaatggaacagc

SEQ ID NO: 851 - DNA, 100 bp, Artificial
  Synthetic
aatgactggaaccaagtgtttaaagagctatccggtcattgaacagcatggtgcaatcttcatctggtttggtatcgatgcaaatgaacaacccgcaccg

SEQ ID NO: 852 - DNA, 100 bp, Artificial
  Synthetic
gccggcgccctcgaaatcattgtttatgctggtgcgattatggtcttgttcgtattcgttgtgatgatgcttaacttagggcaacacacagttgaacaag

SEQ ID NO: 853 - DNA, 100 bp, Artificial
  Synthetic
ccgtggacacgtgatggtcgagttcgtggtgacgttattcaggtctcttcagatgtagcaggacttgtaacggaagtattggttcaagataaccagactg

SEQ ID NO: 854 - DNA, 100 bp, Artificial
  Synthetic
cctgctttgctcgtccaagccatttttgcatatatatgttttcgctggttaagtcccttaaccaacaaatggattgcacaaggctggattgcattaccca

SEQ ID NO: 855 - DNA, 100 bp, Artificial
  Synthetic
gaacaaaaagatcagatgactgatgaaaatattctgcagttacctgacgagtttgaaaatgatttcttgaacttaaatgattcggcttctgaacatcagc

SEQ ID NO: 856 - DNA, 100 bp, Artificial
  Synthetic
ggcgatgtatttgatcaggtggctagagacttagttgagattcctgaagtactcgaatgtcacctcatttcaggtgaatttgactaccttgtaaaagcgc

SEQ ID NO: 857 - DNA, 100 bp, Artificial
  Synthetic
taccaacaacgtagctattcgattattgaagtaaccactcaaggtgaaatcgctttaggtattaaagtacaaggcttggtgtctcgtgcagctcaactat

SEQ ID NO: 858 - DNA, 100 bp, Artificial
  Synthetic
cgatggttttcgcccgaatgtcggcatcattctcgccaacgaggcggggcaggtgctgtgggcgcggcgtatcaatcaggaagcctggcagttcccgcag

SEQ ID NO: 859 - DNA, 100 bp, Artificial
  Synthetic
ccttcttcaaggccggtccggcgggcatcccgacccagaccgcgttcagccagaacacccgctggccgagcctggacgacgaccgcgccgagggctgcat

SEQ ID NO: 860 - DNA, 100 bp, Artificial
  Synthetic
agcgtatccgttcgcgctacgacgaaccgtcgcgcctgtcgctgctctacctcgcccagcagggccgcgcctaccgtggcgtcgacgaccgcgacctgcg

SEQ ID NO: 861 - DNA, 100 bp, Artificial
  Synthetic
tgctggcgcacctggtaaccgtcggcgcctgggaacaggtgctggtcttcacccgtaccaagcacggcgccaaccgtctcgccgagtacctgaccaagca

SEQ ID NO: 862 - DNA, 100 bp, Artificial
  Synthetic
acgagcgcgccagttcctcgcactacccgtacaaccggctggccgaggcgttcttccacagcgacgtgctgttccgctgccagcgcctgctcaaccagca

SEQ ID NO: 863 - DNA, 100 bp, Artificial
  Synthetic
tatgccatgcgcgagtcggtggtcagcgtcctgggcaaccacgacctgcacctgctggcggtggcgcacaagtccgagcgcctgaagaagtccgacacgc

SEQ ID NO: 864 - DNA, 100 bp, Artificial
  Synthetic
tcgccgacgatcccgatacccgcggcgacctctggcgcatgcagccctgggtgccgatccccaaggcctccgaggtacgcccggcgagctacccggccct

SEQ ID NO: 865 - DNA, 100 bp, Artificial
  Synthetic
gttcgtggccaaggtcgcggtcgacagcggcaagctggatgacgccgttgccgagctgaaggcggtcatggacaagccggccgacgccaccctcggcgaa

SEQ ID NO: 866 - DNA, 100 bp, Artificial
  Synthetic
cgcggcaggacccggaaaaggcccttagcctgctcgactactacagctcggcgctacccttctccagcgacgagaaggtcgccatcgcccgcgagatcgg

SEQ ID NO: 867 - DNA, 100 bp, Artificial
  Synthetic
cgagatcgtcgaagtggtcagccccgacaccttcaagcgtccgatctacgccggtaacgccatcgctaccgtgcagtcctcggctgcggtcaaggtgatc

SEQ ID NO: 868 - DNA, 100 bp, Artificial
  Synthetic
gtgcagagttccggcaagcgcgaagtgaccggggccaatgtcctggtggcgatcttcagcgaacaggaaagccaggcggtgttcctgctcaagcagcaga

SEQ ID NO: 869 - DNA, 100 bp, Artificial
  Synthetic
atgggctgcggcaacggcgccagccgcacccagcatcccagcgaactgttcggcgaggactgggccggtgaatgggaagtcgaaggaacggaggacgcca

SEQ ID NO: 870 - DNA, 100 bp, Artificial
  Synthetic
gaccgccgaggaactggagaacctctgcaccgtgatggcccagcgcctgtcgatcctgcatggcctgaacgccccggagttcttcgacaagagcctgttc

SEQ ID NO: 871 - DNA, 100 bp, Artificial
  Synthetic
catggccgccgcccacgaaggcgccgggctggagaacagcctgggcttcaacatcaccctgcccttcgagcagcacgccaaccatacggtggacggcagc

SEQ ID NO: 872 - DNA, 100 bp, Artificial
  Synthetic
gctcctcgcgtggatgcattgctgaatgccgaagtgctggcggccgcgcccagccccgagctggctgaactggtggagttggcgtcgcagccggaaacct

SEQ ID NO: 873 - DNA, 100 bp, Artificial
  Synthetic
ctgaaaagcgacagcagcctgaagcaggaactggaattcaaggacaagttgcaggcgttgatggacaagtacggcatgaccctgcacaacatcatcgcca

SEQ ID NO: 874 - DNA, 100 bp, Artificial
  Synthetic
gccctcggcgcgactgcgggcgatccgcacgctcagcggcaacggcatcccggtgggcgtgctctgctcgccgatgatcccgatggtcaacgacatggag

SEQ ID NO: 875 - DNA, 100 bp, Artificial
  Synthetic
cggtctaccgcgaaggcgtgctgaccgacaacggcaatatcatcctcgacgtgcacaacctgcgcatcgacagcccggtggaactggaagagaagatcaa

SEQ ID NO: 876 - DNA, 100 bp, Artificial
  Synthetic
tggacgacggcggtgacctgaccgagatcctgcacaagaaatacccgcagatgctcgagcgcatccacggcatcaccgaagagaccaccaccggggtcca

SEQ ID NO: 877 - DNA, 100 bp, Artificial
  Synthetic
tggctctgcagccggtcgcagcattgactgtacaggccgccgatcagttcgactgcaaggtatcggccaccggcggctgggattgctccccgctgcagaa

SEQ ID NO: 878 - DNA, 100 bp, Artificial
  Synthetic
tggacaagagcacccagatcccgcccgacagcttcgccgctcgcctcaagcaggccatggcgatgcgcaacctgaagcaggaaaccctcgccgaagcggc

SEQ ID NO: 879 - DNA, 100 bp, Artificial
  Synthetic
gctgaccttgccgatcacgccaacgaactggtcctggctcgcctcgacggcctcctggcggcgcgcccggcgctggccatccgcgagtccgcggaagact

SEQ ID NO: 880 - DNA, 100 bp, Artificial
  Synthetic
cgcggccaccgtggcagccgggtgatcctcgaccgtgtggcggaggtcgatcgcctggtaaatcgcctacccgaggaactgaagaacgtggtggtggagc

SEQ ID NO: 881 - DNA, 100 bp, Artificial
  Synthetic
ccgcagacactgacggaaatgccgctctgggtactgatcctgctcgccgcgctgggcggcgtcagcggcgagatgtggcgtgccgacaaggccggtctcg

SEQ ID NO: 882 - DNA, 100 bp, Artificial
  Synthetic
gctctgctcctgccggccgtgttgctggtcctgctggccggcgccttgctcggcggcggcctggttgcccgccactatcgtccgcaactggaggaggccc

SEQ ID NO: 883 - DNA, 100 bp, Artificial
  Synthetic
ccgcccgcgcggagttgtcccacgccaacgagcaggacctcgccgccggccgcgccaatggcctggagccggcgatgctggaccgcctggcgctgacccc

SEQ ID NO: 884 - DNA, 100 bp, Artificial
  Synthetic
gatggcggtcgccgagcacgaccgcgactgcgacgccgagacccgcgacgcctggcgcgacgtgatgggtcgcggcatcgccgtgatcaagtcgtactac

SEQ ID NO: 885 - DNA, 100 bp, Artificial
  Synthetic
cgttcccctaccgcctgctgcacatgtcggtcgccgcgttcctcgccaccgccttcttcgtcggcgcctcggccgcctggcacctgctgcgcgggcgcga

SEQ ID NO: 886 - DNA, 100 bp, Artificial
  Synthetic
caccgctggccggacgactatttctacggccccggcgacctggcgcggaccacttcctggaacaactccaccgagatcggcctgaactacaagctcgatc

SEQ ID NO: 887 - DNA, 100 bp, Artificial
  Synthetic
gccccacggcggcaccttcgccctcaccgcggtactgatctcggcgctctcctcgacctcgccgaatcccggccggttgtcgctgcaactcaccctcggg

SEQ ID NO: 888 - DNA, 100 bp, Artificial
  Synthetic
cggcgctgctggtggcgatcctggtggcctggctgagcctgttcctggcgccccagggcatcaaccagttcgccctgctgttgaacaagcaggataccct

SEQ ID NO: 889 - DNA, 100 bp, Artificial
  Synthetic
gtcggtgggcgagccgaaggaagagatgatccgcgtgctcgatttcctgccgccgcagatgccggccgacaagccgcgctacctgatgggcgtgggcaag

SEQ ID NO: 890 - DNA, 100 bp, Artificial
  Synthetic
tcacttccggcggtatcgccggcaaggtgaccaaggtcgccgacgatttcgtcgtcgtcgaggtttccgacaacgtcgagctgaagttccagaaggccgc

SEQ ID NO: 891 - DNA, 100 bp, Artificial
  Synthetic
acttcgccgtgagcatcgcctgcaagtacaagggccgcctggagcacgccgtggtcctcgacccggtacgccaggaagaattcaccgccagccgcggtcg

SEQ ID NO: 892 - DNA, 100 bp, Artificial
  Synthetic
cgacgacgtccttctgatccccggttattccgaagtcctgcccaaggacgtgagtttgaaaactcgcctgacccgcggcatcgaactgaacatcccgctg

SEQ ID NO: 893 - DNA, 100 bp, Artificial
  Synthetic
cgacttcgcctcggtgcagcgcgacaacccggaaatggagcgacgttgccaggaagtgatcgaccgctgctggcagctcggcgagcgcaacccgatcagc

SEQ ID NO: 894 - DNA, 100 bp, Artificial
  Synthetic
agctgaccgaggacaacatcaaggacactctgcgcgaagtgcgcatggccctgctcgaggccgacgtggccctgccggtggtcaaggacttcgtcaacaa

SEQ ID NO: 895 - DNA, 100 bp, Artificial
  Synthetic
cgtgaccaacagccgcaatgcgcgcgatggtcgcttcgtcgagcgcatcggtttcttcaacccggttgcgactggtggcgaagtgcgtctgtccgtcgac

SEQ ID NO: 896 - DNA, 100 bp, Artificial
  Synthetic
gcccgcaccttcaccggttacgagatctgcatcccgcgtagcgagttgccctctctcgaggaaggtgagtactactggcaccagctggaaggcctgaagg

SEQ ID NO: 897 - DNA, 100 bp, Artificial
  Synthetic
cgattatgtcctgtccggcggtgagttgccggccatggtgctggtcgatgcagtgacgcggttgctgcccggtgcattgggtcatgcagattccgccgag

SEQ ID NO: 898 - DNA, 100 bp, Artificial
  Synthetic
aatcctgcgtcgcaccgagctttccgaaacccgtgtgaccaaggcggtattcccgcccaccaccaatcaccacaacaccctgttcggcgggactgcgctg

SEQ ID NO: 899 - DNA, 100 bp, Artificial
  Synthetic
cagccggacaccggcgagcaggccctggaaatcaccgacatgctggtgcgctccaacgcggtcgacgtgatcatcgtcgactccgtggccgcgctggtac

SEQ ID NO: 900 - DNA, 100 bp, Artificial
  Synthetic
cgaccgcctggccgaggaaggtctgctcgacgaatcccgctatctcgaaagcttcatcgccagtcgcgcccgtagcggccatgggccgttgcgcatccgt

SEQ ID NO: 901 - DNA, 100 bp, Artificial
  Synthetic
aggcgcgcaacgtcgaggtgatcggcgtttccatcgactcccacttcacccacaacgcctggcgcaacaccccggtggacaagggcggcatcggcgccgt

SEQ ID NO: 902 - DNA, 100 bp, Artificial
  Synthetic
ccaggcctgcgacgacatccgcaacaacggcggccaggtcacccgcgaagccgggccgatgaagcacggtaccaccgtgatcgccttcgtgaccgacccg

SEQ ID NO: 903 - DNA, 100 bp, Artificial
  Synthetic
cagccgctaccgcgtggccggcaccgaggtctatcgcctgcgcggcagccaggccggcaagccctaccacgcgctctacctgctcgacggtccccaggtg

SEQ ID NO: 904 - DNA, 100 bp, Artificial
  Synthetic
gtttgttcatggacaaggctgaagccgatcgttacgacaagatgctggagctggcggaaacgctggccgaggtgctgcagaaggcggtgccgtcgctgaa

SEQ ID NO: 905 - DNA, 100 bp, Artificial
  Synthetic
ggacggtacgctgcggttgctggatcagcgcctgctgccccaggaggaggtctggctcgaacacgagtcggcggccgaggtggccaaggccattcgcgat

SEQ ID NO: 906 - DNA, 100 bp, Artificial
  Synthetic
atcgtcgtttccagcctgatcagtctgagtcgcggcttcgtcaaggaagccttgtccctgcttacctggatagtcgccggcgcggtggcctggatgttcg

SEQ ID NO: 907 - DNA, 100 bp, Artificial
  Synthetic
ttcgccgcggtttcctgcgtgcacgaccgttgcgtcggcggctacgcggtggtggcgatgatcaccggccatggcatcgtcggtttccgcgaccccaatg

SEQ ID NO: 908 - DNA, 100 bp, Artificial
  Synthetic
tcgaggaatcctgccgtatcaatcccgccttcttcaatcctcgcgccgactacctgttgcgcgtgcgcggcatgagcatgaaggacatcggcatcctcga

SEQ ID NO: 909 - DNA, 100 bp, Artificial
  Synthetic
ccatgaccccgaagtatgtcagcacccggctggattcgtcgtcgaagacgagccggagtcgagcgaagtcgaggacaagcgtcctaatccgttcagcgta

SEQ ID NO: 910 - DNA, 100 bp, Artificial
  Synthetic
gacatgcgtcgttcccacgatgcgctcgagtccaatgctctgtccgtggaaaagagcaccggtgaagtccacctgcgccaccacgtatccccggacggct

SEQ ID NO: 911 - DNA, 100 bp, Artificial
  Synthetic
ctgcgcgtcgaccgccacctggtgctggacaatcgcgccgacatggcctggtacgtgcgccgcgatgccagcaccctgcgcgcgaccatcgaccgcttcc

SEQ ID NO: 912 - DNA, 100 bp, Artificial
  Synthetic
gccgccaagacccagaccgtggcgcgcatcgagcaggtccacctgatggtccatgccgaccagaaggccggttcgatccagcgtctgctggaagtcgagc

SEQ ID NO: 913 - DNA, 100 bp, Artificial
  Synthetic
cgccatcctcgaagggctctcgcccaaggaaaaccgcgaggtgccgccgctgcgctacgaggtcgcggcgcaattgaagaaggacttcccggacctggag

SEQ ID NO: 914 - DNA, 100 bp, Artificial
  Synthetic
  misc_feature (83)..(100): n is a, c, g, or t
cactactgatcgccgccggcgttgccgctctttccagcaccgccatggccgccaaactggatgaaaaggttccctacccgaannnnnnnnnnnnnnnnnn

SEQ ID NO: 915 - DNA, 100 bp, Artificial
  Synthetic
ccgatttcgccgccgaggtggtgcggatcctcggggaaagcggattccgtgccaagtccgacttgagaaacgagaagatcggctttaaaatccgcgagca

SEQ ID NO: 916 - DNA, 100 bp, Artificial
  Synthetic
gaagcaggctgcggtcgccaagaagaaccagaagcaggcgcaggtcaaagaaatcaagtttcgtccagggacggaagaaggggattaccaggtaaaacta

SEQ ID NO: 917 - DNA, 100 bp, Artificial
  Synthetic
aggcgaccatgatgaagatttcccacccgatcgtcttcggacatgcggtgagcgtctactacaaggacgtcttcgacaagtggggccaactcttcgaaga

SEQ ID NO: 918 - DNA, 100 bp, Artificial
  Synthetic
aacgtggccctgcgccagcaactcgatctctacgtctgccagcgcccggtacgctggttcgaaggcgtgcccagcccggtgaagaagcccggcgacgtgg

SEQ ID NO: 919 - DNA, 100 bp, Artificial
  Synthetic
aacaccatgttccgtgtggagttggaaaatgggcacgtcgtcaccgcgcacatctccggcaaaatgcgcaagaactacatccgcatcctcaccggcgaca

SEQ ID NO: 920 - DNA, 100 bp, Artificial
  Synthetic
acttcactgcaaggcgcttccgaaacggtggacgtgcaaacgggattccacctgtatcgcggtctgttcatcacgcgcgttgttgcccggcgaaccgcag

SEQ ID NO: 921 - DNA, 100 bp, Artificial
  Synthetic
aacgccttgctgggaggcttcggcggcgccatcttctttgtcgtgttcgcccgtgactacaacgccctgacccgcctcggctacctgctggtgtcctggg

SEQ ID NO: 922 - DNA, 100 bp, Artificial
  Synthetic
aaaaagccagagttaagagagcgatttattacatcagatgatgcttgggatatgatgacatctaagacaaccgtagtgattgttgatacgcataaaccgg

SEQ ID NO: 923 - DNA, 100 bp, Artificial
  Synthetic
caaacgtgtggtaatagagaacagttggtttcacctattacacctatgggaggcagtgcggattcgtacattccatatccagttgaagttgaagttggcg

SEQ ID NO: 924 - DNA, 100 bp, Artificial
  Synthetic
atggttactgggcaacctaaacctattttcccaagattggatagcgaagcggaaattgcatatatcaaagaatcaatgcaaccgcctgctactgaagagg

SEQ ID NO: 925 - DNA, 100 bp, Artificial
  Synthetic
tggcttttgggtagctggcactgaagctaataatgcaacagattatagaaatctagaagcggacatgtcattggctattgtaattggtagcgaaggacag

SEQ ID NO: 926 - DNA, 100 bp, Artificial
  Synthetic
tacagttgtaacaagtgatatgagtgagcaacatgctatctttggatcaggtgcatatagaatatcatctcgcgaaatgtggagagatttaaaagaaaat

SEQ ID NO: 927 - DNA, 100 bp, Artificial
  Synthetic
tatgaagcgaacgtaaaaagctatgttgatcctatcccgcaagcacttattttaacagcaatcgttatcgcctttgcgacaacagcctttttcttagtat

SEQ ID NO: 928 - DNA, 100 bp, Artificial
  Synthetic
tccaatccgtacattaagtgcaaaaggtgtgggtggtttcaatacaattcttaaagaaatcgaagagcgtgcacctttaaaacgtaacgttgatcaagta

SEQ ID NO: 929 - DNA, 100 bp, Artificial
  Synthetic
cataaaacgacagacttattaaaatgtcactattgtggttaccaagagacgccaccgaatcaatgtccaaattgtgagagtgaacacattcgacaagtag

SEQ ID NO: 930 - DNA, 100 bp, Artificial
  Synthetic
ttgatgtgccatctaaattaactcaggcaattgaaacagcattaggtgcttcattacaacatgtcattgtagattcagaaaaagatggacgccaggctat

SEQ ID NO: 931 - DNA, 100 bp, Artificial
  Synthetic
gcatcaaaaacaagcagtaaactttcaaaattacgggaaacaaaatgcgctagaacagtcggaacataccattcaaagtatagaagcagaaataaataca

SEQ ID NO: 932 - DNA, 100 bp, Artificial
  Synthetic
gaccgcaacaattatatttagcggaaactatattagatcagctcatgcatagtgaaaaagcaatgattgaagcatcactaggcagtggtaaatcattagc

SEQ ID NO: 933 - DNA, 100 bp, Artificial
  Synthetic
gtaactatagtgatgcgattcgcttatacgatgaaattaatgaagatgaaatgacttcagaagattatctcaaaaaagccatttcttacgataaaaatga

SEQ ID NO: 934 - DNA, 100 bp, Artificial
  Synthetic
aaattggtaaatcattccgtaatgaaatcactccaggtaacttcattttcagaacaagagaatttgaacaaatggaacttgaattcttctgtaaacctgg

SEQ ID NO: 935 - DNA, 100 bp, Artificial
  Synthetic
ttatcgaacattagatgaacgaggatataatgccgtaaaccaaattgtaggttatttattatcaggtgaccctgcgtatattccacgccaaaatgaagca

SEQ ID NO: 936 - DNA, 100 bp, Artificial
  Synthetic
acacatgcggcaggaattattattaatgaccatccattatatgaatatgcccctttaacgaaaggggatacaggattattaacgcaatggacaatgactg

SEQ ID NO: 937 - DNA, 100 bp, Artificial
  Synthetic
gatattgcgcaagattttggtggcggtggtcatccgaatgcgtcaggagtttcagtgaacagctgggatgaatttgagcaacttgctacagctttacgca

SEQ ID NO: 938 - DNA, 100 bp, Artificial
  Synthetic
acaatgacaactgttcctgaagaagagctaccattgttgttacctgaaacagatgaaatcaagccatcagggactggtgagtctccactagctaatattg

SEQ ID NO: 939 - DNA, 100 bp, Artificial
  Synthetic
tttggagtcagtgcattaatttttccatatgttggtttacgcttaagatggcaatggtatcaatcgggacttaaaacatggcaagttaatttaatatcat

SEQ ID NO: 940 - DNA, 100 bp, Artificial
  Synthetic
actatagcgaagaacgtcctattacaaaaaaacatattcaccaacagaatagaaagaaaatacttttcagagaagtagttcagacgactagacaagctta

SEQ ID NO: 941 - DNA, 100 bp, Artificial
  Synthetic
tttaatatttccgcagcgacgccagtagttattatgtctattttaagttttattatgctagtcattttgacgatgattagtgcattggttaaaccagtaa

SEQ ID NO: 942 - DNA, 100 bp, Artificial
  Synthetic
caattggcacaagcttacttgagacatgtaaaccctaaagtaattgccgtcacagggtctaatggtaaaacaacgactaaagatatgattgaaagtgtat

SEQ ID NO: 943 - DNA, 100 bp, Artificial
  Synthetic
ttccaaaagagaattggtgggtatttatcgtcttattactcttagtcggtaatgtcgaagtgacaggatttaaaatgcttaaaaaagatctaaaaggcgt

SEQ ID NO: 944 - DNA, 100 bp, Artificial
  Synthetic
attaaggttaatggtgaaaagtacaaagttagacctgtcacgttaacacttagcagagctgacactaaaaaaattacattagctgtattagaagaagcta

SEQ ID NO: 945 - DNA, 100 bp, Artificial
  Synthetic
ttctgggaaaggtttagttattatggcatgcgtgccctactcattttctacatgtactttgccgtaacagataatggccttggaattgataaaacaacag

SEQ ID NO: 946 - DNA, 100 bp, Artificial
  Synthetic
aaatatccaacgactcaaatcgaagcgagtggcttagatgttggactacctgaaggacaaatgggtaactcagaagttggtcatatgaatatcggtgcag

SEQ ID NO: 947 - DNA, 100 bp, Artificial
  Synthetic
cgctaatttaactaaagaatgtacagtaatcggtgtttcaaatcgtattgagatttgggatagagaaacttggaatgatttctatgaagaatctgaagaa

SEQ ID NO: 948 - DNA, 100 bp, Artificial
  Synthetic
ttacgacttgggtgtttcaagcccacaactcgacattccagaacgaggattcagttatcaccatgacgcaacattagacatgcgtatggaccaaacacaa

SEQ ID NO: 949 - DNA, 100 bp, Artificial
  Synthetic
agaattcttcttatgaacgcatatacgaaaaggctaagaaacaggggatgagccttgagaacgataatgtaaaggtagtgcgtagtaatggcgaagcaaa

SEQ ID NO: 950 - DNA, 100 bp, Artificial
  Synthetic
gtggacctttaggtggtgccattgatgtattggcagtcatagctacagtaacaggcgttgctgcaacattaggtttcggtgcattgcaaataaacgaagg

SEQ ID NO: 951 - DNA, 100 bp, Artificial
  Synthetic
taccggaagcgatgaggatgtcagtccgtaataatggcggtggtcattttaaccattcattattctgggaaatactatcacctaattctgaagaaaaagg

SEQ ID NO: 952 - DNA, 100 bp, Artificial
  Synthetic
acacgattcactaatgaacatggttatgaaatcgaaagtaaacgtggtggtggtggttacatccgaatcactaaaattgaaaataaagatgcaacaggtt

SEQ ID NO: 953 - DNA, 100 bp, Artificial
  Synthetic
tttgaaagatattgcacatgttggtaaatttgggtgtgctaattgttatgcaacatttaaagatgacatcattgatatcgtccgcagagttcaaggtgga

SEQ ID NO: 954 - DNA, 100 bp, Artificial
  Synthetic
cgacaaaagttagacacttataatcaattagaaacacaagaccgtgtttttcgctcgctaggtattttacaaaactgtagaatgataactatggaagagg

SEQ ID NO: 955 - DNA, 100 bp, Artificial
  Synthetic
gcgggtcgcacgatatcagaagagtataatgtccctttattaatgaagtttgagttacatggaaaaaacaaagacgttattgaatttaagaacaaggtgg

SEQ ID NO: 956 - DNA, 100 bp, Artificial
  Synthetic
agctagtgtcatgtttcttattagaagtggatgacagcttaaattcaattaactttattgattcaactgcaaaacaattaagtaaaattgggggcggcgt

SEQ ID NO: 957 - DNA, 100 bp, Artificial
  Synthetic
gaacacacaagaagatatgacgaatatgttttggagacaaaatatatctcaaatgtgggttgaaacagaatttaaagtatcaaaagacattgcaagttgg

SEQ ID NO: 958 - DNA, 100 bp, Artificial
  Synthetic
ggtttaggtaatcctgaagaatataaagatttagtagtaagtgttcgagttggtatggaaatggatagaagtgaattacttagaaaacttgtagatgtgc

SEQ ID NO: 959 - DNA, 100 bp, Artificial
  Synthetic
tggtcttggatacgtcacattaggtcaacaagctacaacgttatcaggtggtgaggctcaacgtgtgaaacttgcatctgaacttcataaacgttcaact

SEQ ID NO: 960 - DNA, 100 bp, Artificial
  Synthetic
aaagcgcacttaaaaatgaatctgacaatgcgagcaaacagagattacaagaactacaagaagagcttgccaatgaaaaagagaaacaagcagcacttca

SEQ ID NO: 961 - DNA, 100 bp, Artificial
  Synthetic
tcggtaatccagagactacaccaggtggacgtgcattaaaattctatagttcagtaagactagaagtacgtcgtgcagaacagcttaaacaaggacaaga

SEQ ID NO: 962 - DNA, 100 bp, Artificial
  Synthetic
tccattacctgaacacttaacatcgacacataatagcgacatattcatattaaacgtcgtaggcgacagtatgattgaggctggtatattagacggagac

SEQ ID NO: 963 - DNA, 100 bp, Artificial
  Synthetic
gctcactcggaacaagtgtacgaaatgactgaccatcaaattaagaacaatacgataaataaagcatacgaacataaagaccctacaaacaatagcgaac

SEQ ID NO: 964 - DNA, 100 bp, Artificial
  Synthetic
attgatgaagatgccgtcaatattttaattagtcatctgactgttcaaggtggaaagacatctgattctgaaagaccattaactattggaacggttgaat

SEQ ID NO: 965 - DNA, 100 bp, Artificial
  Synthetic
gatgcaatgacttatgccttgtttggtaaagcatcaactgaacaaagagaagaaaatgatttgagaagtcatttcgctgatggtaaacagccgatgtcag

SEQ ID NO: 966 - DNA, 100 bp, Artificial
  Synthetic
agcagagttcgagcaagaaaaaaagtggcaagaacgatacattttgcctttggctatagtgatgaaggcggtgtacataagcaatatactttgaaagatc

SEQ ID NO: 967 - DNA, 100 bp, Artificial
  Synthetic
aataacagtgccaggcaaaaatgatgaagtacaacgctgtattactgctcatgttgatactttaggtgcaatggttaaagaaattaaagaagatggtcgc

SEQ ID NO: 968 - DNA, 100 bp, Artificial
  Synthetic
gaaaaaatggcaatttgttggtactacagctttaggtgcaacactattattaggtgcttgtggtggcggtaatggtggcagtggtaatagtgatttaaaa

SEQ ID NO: 969 - DNA, 100 bp, Artificial
  Synthetic
gcatgcggtgcagcagcgccagatatatatgattacgacgacgaaggtattgctttcgtaatccttgacgataaccaaggtactgcagaagtacctgagg

SEQ ID NO: 970 - DNA, 100 bp, Artificial
  Synthetic
cagataggcaattgagtatattaaacgcaattgttgaggattatgttgattttggacaacccgttggttctaaaacactaattgagcgacataacttgaa

SEQ ID NO: 971 - DNA, 100 bp, Artificial
  Synthetic
ggctacacgaggcgctacaatatgcccaacctgtagaagttaaattttataataatggctttgtagattcagtacgcttaaccatttatcgtattgatgc

SEQ ID NO: 972 - DNA, 100 bp, Artificial
  Synthetic
tgtggggaaatgcaaaagatgcaatcaataacgattttaaaaacatggcaacagtatatgaaaacacaccatcgtttgttccacaaataggtgatgtggc

SEQ ID NO: 973 - DNA, 100 bp, Artificial
  Synthetic
agtgatacaccgccagaaaatccagtcaatgatatgctttggtatgatacaagtaaccctgatgttgctgtcttgcgtagatattggaatggtcgatgga

SEQ ID NO: 974 - DNA, 100 bp, Artificial
  Synthetic
gtcggcggtgactttgtgatatccaatcttggcgaaggatataaagcaactaattttcctgatgcaaaaggttgggttggtgctggcacgaaacgagggc

SEQ ID NO: 975 - DNA, 100 bp, Artificial
  Synthetic
aaaggcactccagagttcaaagatatgcttaaaaacttgaatgtaaatgatgttctatatgcaggtcataatagcacatgggaccctcaatcaaattcaa

SEQ ID NO: 976 - DNA, 100 bp, Artificial
  Synthetic
tcattagcagtaggtttaggaatcgtagcaggaaatgcaggtcacgaagcccatgcaagtgaagcggacttaaataaagcatctttagcgcaaatggcgc

SEQ ID NO: 977 - DNA, 100 bp, Artificial
  Synthetic
gctaataattgggctgctgctgcacaaggtgctggattcacagtaaatcatacaccttctaaaggcgctatcctacaatcttctgaaggaccatttggtc

SEQ ID NO: 978 - DNA, 100 bp, Artificial
  Synthetic
gtcgttgcaacagcagatcactctactggtggtctaacaattggtaaagataaaggatacgaatggaatcctcaaccgattaaatcgatgaaacactctg

SEQ ID NO: 979 - DNA, 100 bp, Artificial
  Synthetic
caagaattccaagagatacttaatagtggcattcatcctgaatggctttattgtgcaaaggctaatcttgttttagagcctgcttatactggcgaaggca

SEQ ID NO: 980 - DNA, 100 bp, Artificial
  Synthetic
tatttatcgacagtatcaccatgaaggcgcaccagtttatgaaattataaccaaaacgtttcagcatgtttcaattaaatgtgacgattcatttagtgat

SEQ ID NO: 981 - DNA, 100 bp, Artificial; identical to SEQ ID NO: 39
  Synthetic

SEQ ID NO: 982 - DNA, 100 bp, Artificial; identical to SEQ ID NO: 40
  Synthetic

SEQ ID NO: 983 - DNA, 100 bp, Artificial; identical to SEQ ID NO: 41
  Synthetic

SEQ ID NO: 984 - DNA, 100 bp, Artificial; identical to SEQ ID NO: 43
  Synthetic

SEQ ID NO: 985 - DNA, 100 bp, Artificial; identical to SEQ ID NO: 45
  Synthetic

SEQ ID NO: 986 - DNA, 100 bp, Artificial; identical to SEQ ID NO: 47
  Synthetic

SEQ ID NO: 987 - DNA, 100 bp, Artificial; identical to SEQ ID NO: 48
  Synthetic

SEQ ID NO: 988 - DNA, 100 bp, Artificial; identical to SEQ ID NO: 49
  Synthetic

SEQ ID NO: 989 - DNA, 100 bp, Artificial; identical to SEQ ID NO: 42
  Synthetic

SEQ ID NO: 990 - DNA, 100 bp, Artificial; identical to SEQ ID NO: 51
  Synthetic

SEQ ID NO: 991 - DNA, 100 bp, Artificial
  Synthetic
gaagtgttaattcgaaccgactgataaacattcccactccatcccagctgaacacctttcagagtatcggcatgagggaacgctttatttattgactggt

SEQ ID NO: 992 - DNA, 100 bp, Artificial
  Synthetic
gttcatatgatgtataaccatcatgcgacagcctctcctgaaaaattgcaaaaactgctaagcctgcaattggtattagcaatatatagattagtttttt

SEQ ID NO: 993 - DNA, 100 bp, Artificial
  Synthetic
cggtcgaggtatagccggtgacccggaaatcggcttttaacgctgacagtcgctgattgatacgagccagaactacctgctcagaggaataggaaggttt

SEQ ID NO: 994 - DNA, 100 bp, Artificial
  Synthetic
aagacttccaaatcccattgcaactgctgtaactcttttaaggtctccttccgtattcaggtcaaagtaaagttgcgctttatagctgataaatgttggc

SEQ ID NO: 995 - DNA, 100 bp, Artificial
  Synthetic
cagcaacaaattggcggcggcgttatcactgtattgcacggcggccgcggacagctccgccaccgtcatgcctgttgtcagatatttttccgagatgggt

SEQ ID NO: 996 - DNA, 100 bp, Artificial
  Synthetic
cgaaacccggcatgtcgagataggaagtgtgctgccagacattcggtgcgagctggcggaaaaccagatcgccaaaccgttggtcgccagtttccatttg

SEQ ID NO: 997 - DNA, 100 bp, Artificial
  Synthetic
ctgatttgctccgtggccgaaattcgaataccaccgtcgagccagaaactgtctacattgcccgaaatgtcctcattaccataatcgaaagcatgtagca

SEQ ID NO: 998 - DNA, 100 bp, Artificial
  Synthetic
tcgtcccattgacgtgcttttccgcaatcggattatagttaacaaggtcagattttttgatctcaactcgctgatttaacagattcggttcgctttcact

SEQ ID NO: 999 - DNA, 100 bp, Artificial
  Synthetic
gataggcgtcagtgtttacaagaaccaccaaaccgtgtttagaaacaacaccccaaccgttaacttcttcgaacgatgtatgaacataaacaccttcttc

SEQ ID NO: 1000 - DNA, 100 bp, Artificial
  Synthetic
gaccgtccggtttaacaaaacaaccaccgaataaaattttcttttcaggtaaccaaaccactacgttatcttgagtgtgccccgggccgggataaaaaac

SEQ ID NO: 1001 - DNA, 100 bp, Artificial
  Synthetic
taagccactctattccccctgtgctgtcgctatggaaatgtgaggaaatagtgcctttgattttatagccgcgctccacaaaccaattgactaacttttc

SEQ ID NO: 1002 - DNA, 100 bp, Artificial
  Synthetic
cttttagccccttaacagcctgctcccaagtgcgcttcaatagtgatgcgcccccaatttcactatgactcgaaacaaccagttttgcattaccatactt

SEQ ID NO: 1003 - DNA, 100 bp, Artificial
  Synthetic
taagccactctattccgcccgtgctgtcgctatgaaaatgagaggaaatactgccttttattttatagccacgttccacaaaccaagtgactaacttttc

SEQ ID NO: 1004 - DNA, 100 bp, Artificial
  Synthetic
tctttttcttaactagccaatagctaactccgctaaatgaatttttagcttgtaccttaccgtcttttttaagaagttcatttgttaattcagatgcata

SEQ ID NO: 1005 - DNA, 100 bp, Artificial
  Synthetic
gcgcacggccggcacgtataccacaagattgtcgcccgaatgcgcagcaccaggatagaaaacctctacgggaccgaagcgcaccacatctccactagag

SEQ ID NO: 1006 - DNA, 100 bp, Artificial
  Synthetic
cgttacgggaagtccaatttgcttctcaatctccgcgagaagtgccgctgtgtttttcgcaccccacgctgtatcaatcaaaagcaactcatcaccatca

SEQ ID NO: 1007 - DNA, 100 bp, Artificial
  Synthetic
tgaaacttgtattgcccctcttaaggtcaagtctctttcccattgcttcatggctcttggctttccgtcccatttgaaaacctgatgctcattctttatg

SEQ ID NO: 1008 - DNA, 100 bp, Artificial
  Synthetic
gctcagaattttaacatacgcactggcgcgctgttcctgcatccaggttgccgcttcttcagagaatttgcggttcatcagcatgcggtaagcacgatct

SEQ ID NO: 1009 - DNA, 100 bp, Artificial
  Synthetic
aacgcagacgcccagctcacgttcgtcttctgttaataccgaataactggccgctaacccggcgaaaataagttggtcaactttcagaccacaacgttcc

SEQ ID NO: 1010 - DNA, 100 bp, Artificial
  Synthetic
ccgatcgcatccagcattttgtggcgaacaaattcgtcttcaaagcgcagaccgtcttcgttcagtacgcgataatcgtcaacaacgatggcacaatcga

SEQ ID NO: 1011 - DNA, 100 bp, Artificial
  Synthetic
ggctcgcatcgtcctgtttggactgttgtgcacttctgcgccccatgtaccagccgtaagcggcggcaacgggtaaaagcagaaacaacaactccagcat

SEQ ID NO: 1012 - DNA, 100 bp, Artificial
  Synthetic
taccgcctttacgctgcaggccgctgaacagttttttaccggtggcatcgctcacttccagccagcagtcggcggaaaagttcatcaccagatcctgcgc

SEQ ID NO: 1013 - DNA, 100 bp, Artificial
  Synthetic
cgagatgtaaaggggtatcaaacgtatgggcggcatacttctccagcataccggcaggctgatcctgctcatccagcaaaatgacgtgttccccggccat

SEQ ID NO: 1014 - DNA, 100 bp, Artificial
  Synthetic
ggatcacccggccatcgcggatcagtttatccataattttggtcgctaactggaacgggatcgcaaagccaatgccttccggcgtttcgccgtcattgct

SEQ ID NO: 1015 - DNA, 100 bp, Artificial
  Synthetic
gcgcattgcctttcggacgcagctgggcaaggaagacgtcatggaagcggttgccgttgacgctttcgataaacatcaccgcgttaccatcgctggcctg

SEQ ID NO: 1016 - DNA, 100 bp, Artificial
  Synthetic
gacagcgccatcgctttatgctgcgcttccatcttatcgatctgcgcttccgccttcgccttatcgaaggtgtcgctggcgatcagatcgtgcatcgcgc

SEQ ID NO: 1017 - DNA, 100 bp, Artificial
  Synthetic
attcctgacgcggcgttttcacggtttctttaatcggtgtactggagaccacttgcgcatactgcgggccgcgatccaacacgttgagaccagcgacagc

SEQ ID NO: 1018 - DNA, 100 bp, Artificial
  Synthetic
gaccggtcatgctgctggattggatccccgtgaggcttaacaccagcccgaacacgaccatcactgccaggttcgtcagcaggaaaagcgcgattcgcat

SEQ ID NO: 1019 - DNA, 100 bp, Artificial
  Synthetic
aacggttatcacgccattcatagtgacgacgccagtaatcacggtcgcgccagctgccaccgtcccagtagttaccgtaattgtcacgatcgcctatttg

SEQ ID NO: 1020 - DNA, 100 bp, Artificial
  Synthetic
cagagcactgcgccaacgaagatgcttaggattgcgccatgcgcaaagaattgtggcaggttaagctgcggaagctggttcagaatggagtaacctaccc

SEQ ID NO: 1021 - DNA, 100 bp, Artificial
  Synthetic
cgacggattgataccgcgcttacgcagcaggtcgtaagagtagtcatccgcttccgattcctgacgctgggagaactgcgagttcaccagtttttcgccc

SEQ ID NO: 1022 - DNA, 100 bp, Artificial
  Synthetic
cgcgccttctcagtcggcgaccagcgagcatcgtactgcttggaaataagccagttacgatccgcagtaatcgcctgattctgcttggtaatataaggca

SEQ ID NO: 1023 - DNA, 100 bp, Artificial
  Synthetic
ggcgcctgcgcacgcatttcacggcaaagctcaaacaagttatcacgcagatggtcattttcgctgactgacatgtagcctttggcctttcgcagttgca

SEQ ID NO: 1024 - DNA, 100 bp, Artificial
  Synthetic
aatgaacataaagtgcggtgctgactccgcgggcggtgaggtattggcacttaagacccagaccgccgacgttttcctcactgtggaataacaccccata

SEQ ID NO: 1025 - DNA, 100 bp, Artificial
  Synthetic
cagtttgttgttggtgttagcggaagtaatgctgtagccggtcgcgccagcggcttcggctttagcagccagttttgcttccagaccatctaaagtggtt

SEQ ID NO: 1026 - DNA, 100 bp, Artificial; identical to SEQ ID NO: 1008
  Synthetic

SEQ ID NO: 1027 - DNA, 100 bp, Artificial; identical to SEQ ID NO: 1009
  Synthetic

SEQ ID NO: 1028 - DNA, 100 bp, Artificial; identical to SEQ ID NO: 1010
  Synthetic

SEQ ID NO: 1029 - DNA, 100 bp, Artificial
  Synthetic
ctcagcgcggacgcgctccagatcttccggggtatccacgccggtgccgggcacttcggccgccacggcgacatggattttctcgccataccacagcact

SEQ ID NO: 1030 - DNA, 100 bp, Artificial
  Synthetic
gacgctggcgcaccaaatcgttgatcgcgttattggcgcgctggctgatggtttcgctggtctgctcaaacgcatcactgacgtggcggaacgcatccac

SEQ ID NO: 1031 - DNA, 100 bp, Artificial
  Synthetic
cgtgattatccagctcgtcgagaccgatatgacggcccgcgcgcagggcgctgtccagcgccggaaataacggattggccaacgcctgcgccagcttaac

SEQ ID NO: 1032 - DNA, 100 bp, Artificial; identical to SEQ ID NO: 1011
  Synthetic

SEQ ID NO: 1033 - DNA, 100 bp, Artificial
  Synthetic
ctttccgcctgcgaaccgcttgccgacatgcgcggtaccagaacatacctgttcactaacgcaattaccaccatcccggcgaccagcgcacatttgatca

SEQ ID NO: 1034 - DNA, 100 bp, Artificial
  Synthetic
cgtctcgccgtggccgcgccaggcccagaaattctgcgtatcgccgaaatccatcggttcaacggtaaagccgatcgcacgcaggcgttcaatcattaac

SEQ ID NO: 1035 - DNA, 100 bp, Artificial; identical to SEQ ID NO: 1012
  Synthetic

SEQ ID NO: 1036 - DNA, 100 bp, Artificial
  Synthetic
tcacctgccccggatgattcgggcggataaagcccgtcgccagcagcgtctgctcaagatggtcgtagaatcgctccagatcgtccaccagcgggtacgg

SEQ ID NO: 1037 - DNA, 100 bp, Artificial
  Synthetic
gcgatttcaccgcctgcggatcggaaaccagcagcacgaccatgtcgttatcaaggcggatcgcctgatactgacgcgtatctttttcgcttttgcggat

SEQ ID NO: 1038 - DNA, 100 bp, Artificial; identical to SEQ ID NO: 1013
  Synthetic

SEQ ID NO: 1039 - DNA, 100 bp, Artificial
  Synthetic
tctggatggtgttcatcagcgaataccagtccttctcgatacgttgcatatacaggcggctttcaccacgcgccaccggataaaccggcattaacggcgg

SEQ ID NO: 1040 - DNA, 100 bp, Artificial; identical to SEQ ID NO: 1014
  Synthetic

SEQ ID NO: 1041 - DNA, 100 bp, Artificial
  Synthetic
gcgcgccaggcggtagatgagcttcatgtccgctttaatgatcggcaaaatatccgggcggataaccttgatcaccacctctttgccattctccttcaga

SEQ ID NO: 1042 - DNA, 100 bp, Artificial
  Synthetic
tcgaattatagggcaggacgtacatgaccggacgcgaggtatcgagtcctaattcctgggcaggctctgccggaatagacttgctttttaccagcacctg

SEQ ID NO: 1043 - DNA, 100 bp, Artificial
  Synthetic
aagttgtccgcttcgatccagccaaggttgccgcgcaccacaaagcggtggcggtcatagagggtacggatccagacgtcctgggcctgcatcacgatga

SEQ ID NO: 1044 - DNA, 100 bp, Artificial
  Synthetic
caagttgcttacgccaaacgtctcgccgattttacccacaacctgaccactttgtgcaacccccataccaataagcattgaggtcatcgcggcgctatcg

SEQ ID NO: 1045 - DNA, 100 bp, Artificial
  Synthetic
tgcggtgaccccaccacagctgacgggagatacaccagtcctgaatatcgcgcatccaggagaagtacatattttcgtactgcttcggcacgaactgaat

SEQ ID NO: 1046 - DNA, 100 bp, Artificial; identical to SEQ ID NO: 1015
  Synthetic

SEQ ID NO: 1047 - DNA, 100 bp, Artificial
  Synthetic
cagcacgataaagaagaacacctggaacggctccatgcccagcagcgtgccgacgccgatgcccaccagcatgccgaccacttcgccgcacagcatcggg

SEQ ID NO: 1048 - DNA, 100 bp, Artificial
  Synthetic
ctgacccaggtcccgccgagcatattaacgaaagtaaagatccacacgatggcaatacaggcaatacctgctggcaccgggttatttaaaattgggaaga

SEQ ID NO: 1049 - DNA, 100 bp, Artificial
  Synthetic
gacgacgaccgctttatccttcaggtccgggaaatctttgatcggaccgcctttcttcaccagcagacgggtaccgaccacgaagatggtatcggagaag

SEQ ID NO: 1050 - DNA, 100 bp, Artificial
  Synthetic
gtggattttaccgtaggaacgaattttttcttcatagcgacggcattccgcatcgatgtccggcgcgttaccattcagcaggttgatattttctgccgga

SEQ ID NO: 1051 - DNA, 100 bp, Artificial
  Synthetic
gatctttggttttgatattggctttcgcgtagtcaacggagccggtgccgctcttcaccgcgaccactttaccgttcagatctttgacatctttgatgtc

SEQ ID NO: 1052 - DNA, 100 bp, Artificial; identical to SEQ ID NO: 1023
  Synthetic

SEQ ID NO: 1053 - DNA, 100 bp, Artificial
  Synthetic
attgccgtcagctttctgatcgacgctacggttagagctggagtagcctgcagacagtgcgataccgttgtcgaacgcgtaggtggctgcggtgctgaag

SEQ ID NO: 1054 - DNA, 100 bp, Artificial
  Synthetic
tactcttccggtcggtcgattttgccttccatgttctcatgcggaaacaggtttggattgaacaccgcctggcggatatcgcacagaaaaccaatccgct

SEQ ID NO: 1055 - DNA, 100 bp, Artificial
  Synthetic
gatggcgtgtagcgtttccgcatggtggcgcaaaacgaggaagacatcgctatccagagcgccatttataacatccgcttccataatctgtaaggcttcc

SEQ ID NO: 1056 - DNA, 100 bp, Artificial
  Synthetic
ccgcttcaacatcgatactctgcggatcgcaggtgaccaccccgaagctggcgccctcatagtcgatacgctgttcgccgaggaagtagacgccgcacag

SEQ ID NO: 1057 - DNA, 100 bp, Artificial
  Synthetic
cggctgggtaaactggtctttggtacgatcgtaagcggtacagcccgccagtaaggttaacgcgacggtgacgcccagtattcctgctaagcttttgttc

SEQ ID NO: 1058 - DNA, 100 bp, Artificial
  Synthetic
ctcgtccggcgacagcagggtggtcatttcataggaaaaatcatagatcggcaaaaaggctttgatgcgtccaccaatccgttggtgcaggtacaccgct

SEQ ID NO: 1059 - DNA, 100 bp, Artificial
  Synthetic
cccagtgcgaattgtcagcctgcacgtccacccgcaaattgctgtacacccgaccgtcacggatggcgagtccggttgtcagcatattgacgatctgcct

SEQ ID NO: 1060 - DNA, 100 bp, Artificial; identical to SEQ ID NO: 1020
  Synthetic

SEQ ID NO: 1061 - DNA, 100 bp, Artificial
  Synthetic
tcggccccaccccctcgatagtctcaagcgagctggtgctcttcactttcgcccgttttttgcgatgcccggagatcgcatgatcgtgcgattcatcgcg

SEQ ID NO: 1062 - DNA, 100 bp, Artificial
  Synthetic
gcccgccacggagcgcgcgattttgcgcgtcgcttcaagaccaccgatcccaggcatgttcatgtccatcaggacgacatctgcggaattagcccggcac

SEQ ID NO: 1063 - DNA, 100 bp, Artificial
  Synthetic
ggtgttggcgatggagtcttcgatatgcagaccgaaataggtccccataatgcagaaaatggagaaggtgacgtagcacagcagcttgtgcggcaggcga

SEQ ID NO: 1064 - DNA, 100 bp, Artificial
  Synthetic
aacaaaatcgatatccagctgcacaccgccgtcaacgtcagtgaaggttgggttaatttggcacggctcagattcgacattgcgggctttttcgcttaac

SEQ ID NO: 1065 - DNA, 100 bp, Artificial
  Synthetic
cggtaggtagggaggccggcatcgctgaataaacgtcgcgcttcctgcgaggaaaattcgccgcaccagttggtcagcacggtgacatatttaccgcgcg

SEQ ID NO: 1066 - DNA, 100 bp, Artificial
  Synthetic
ttgcatcagcgataaaaccctgcggctccttagacagaatgatgtgcgggttgattaaatgagtttgccacttatccagtttggcgagacggtctgcgac

SEQ ID NO: 1067 - DNA, 100 bp, Artificial
  Synthetic
cgcgccgtcaaacttcagcgtgacaaacatgtacgagccaagcgtggtgagccagctcccccaaaggcagaactgcaggaacgacagtattttgagctgc

SEQ ID NO: 1068 - DNA, 100 bp, Artificial
  Synthetic
accgcccagggcataaatataacggcccaggcgagtatggtgcagcatgtaccaggccgccaggaagacaatcgccatgatccataccggcgtcgggatc

SEQ ID NO: 1069 - DNA, 100 bp, Artificial
  Synthetic
atcactgttaagaatggcatcgacaatcgcctggtggagatcgagcttcaccacttcattttgcgtaatcgacgtgaagtaggtgtggtagaccgaatga

SEQ ID NO: 1070 - DNA, 100 bp, Artificial
  Synthetic
ccagcttgtccgggtgttctacggaaactttaatgccggtgtctttttcaaactttttacccacttcagcgaggccgttgtagcctttgtcgccgttaat

SEQ ID NO: 1071 - DNA, 100 bp, Artificial
  Synthetic
ggccagagagagcttaccgaagccaaggtcaacgttttccagacctgcacccgggccggagatatcccagtagtagaagtcgatcatgtgaacgtcatga

SEQ ID NO: 1072 - DNA, 100 bp, Artificial
  Synthetic
ggatctgcaccagggtgccttccatcatattcatcgccaccaggccgcgggcctgcccgtcatcgaccagcaggtcaaggacgaaatgttcgtcaaagcg

SEQ ID NO: 1073 - DNA, 100 bp, Artificial
  Synthetic
accgtggccattttctgcaggccagccgtctggtagcgctggatctcctgcggatggtcggtggcgggcggcggggcttccggcgttccctgcagggcgc

SEQ ID NO: 1074 - DNA, 100 bp, Artificial
  Synthetic
acgggcgcgctcggtatagttggcggtctcttccatcaaatgttgcttgaacatctgtttcatttcgttaaagccgctgaagccgaaggcgttggcaaaa

SEQ ID NO: 1075 - DNA, 100 bp, Artificial
  Synthetic
cgacgtcgcgatagtccagcagcttatgctcggcgaggatcacaatgtgctgcacttccgtcaccacatgcatattaatgccgcgatcgacatttttgcg

SEQ ID NO: 1076 - DNA, 100 bp, Artificial
  Synthetic
cccagcgagagcatggacaggtcgtgggtataaaacagcgcgataatcacgatagccccgaggtcatcaataatcgccagcgccatcaggaaaatcttca

SEQ ID NO: 1077 - DNA, 100 bp, Artificial
  Synthetic
cactcgccgatcttcaccgaaaatagcccttcctgctgcgtcgagtcgatcgggcagtcagagataatcatgtcgagcttatgctggctcagctgctcca

SEQ ID NO: 1078 - DNA, 100 bp, Artificial
  Synthetic
tgtccatccacagcttgagcagcggcggtacgctataccactgcataggatgctgccagataaccagatcggcacgggccagcgccgcctgctcggcggc

SEQ ID NO: 1079 - DNA, 100 bp, Artificial
  Synthetic
agtacgctacggcatcgtcaaaatctttgcctttcggcgcatgcagacggccgcgtacgtaattgaaggtggtttcgtccggcgcgaccaggcccgcttt

SEQ ID NO: 1080 - DNA, 100 bp, Artificial
  Synthetic
tttaccgtcaatgcggctgcggattttctggtcgaggtagacgccataggcggcaatcagcaccgcgaagacaatccccagcttgaccagcagccacagc

SEQ ID NO: 1081 - DNA, 100 bp, Artificial
  Synthetic
gtctggataaagttttcgtagttttccacgttgaggccgctacggcccagcgcggagacaatcccggaggtcacggtttcgcccagaccgaacgggttgc

SEQ ID NO: 1082 - DNA, 100 bp, Artificial
  Synthetic
tttgcagcgtaaaccccagaatatcgcaatagaacgctttactgcgggcgtagtcggtcgcaatgatggcaatatggtgaacccgtttcaaacccagcat

SEQ ID NO: 1083 - DNA, 100 bp, Artificial
  Synthetic
caactgcttttccgtcttcacattgtccagacggtcgctatagcttttaccgtttggcgaggtgatcttcagcgcggtatggaccagaaacggcggaatg

SEQ ID NO: 1084 - DNA, 100 bp, Artificial
  Synthetic
gaggcggcatcaggctgcggcttctcttcgatgatattgactatctcctgcgggtgcgagccgctgaacatattggtcagcatattgcccagcaccacgc

SEQ ID NO: 1085 - DNA, 100 bp, Artificial
  Synthetic
tgcgaaagcgtttaatcaggcttcccagctcgcgccgacgctttttattacgcatctgcatctggtgcagaccatacagcagcggctcccaactgccgcg

SEQ ID NO: 1086 - DNA, 100 bp, Artificial
  Synthetic
gctcgcccgcctgcagccctttctcgaccgcaaactgctgcccctgctgccccgcgagggtcagacgacgctgcccggcggtgtggtccggcttcagcac

SEQ ID NO: 1087 - DNA, 100 bp, Artificial; identical to SEQ ID NO: 1025
  Synthetic

SEQ ID NO: 1088 - DNA, 100 bp, Artificial
  Synthetic
tcagcatcggcccaaggatatagccgaggaacccggtgaaggcgaaggcggaaataatcccggtgggtttattcgccgttttgtaggtcaggaacatcag

SEQ ID NO: 1089 - DNA, 100 bp, Artificial; identical to SEQ ID NO: 1017
  Synthetic

SEQ ID NO: 1090 - DNA, 100 bp, Artificial
  Synthetic
cgtaatgggcagggtctgcgggtcgtcatcgatatgctcagacagcggctgatggacctcaaccagacggcggccatccggctcaaccgacgccttgatc

SEQ ID NO: 1091 - DNA, 100 bp, Artificial
  Synthetic
cgatcatgctgtcgccagcggctttgacaaaataggtcgcgctgggatgctgcaccagcagctcgttgaggtcgattcgcttctcaacatagtcctgagc

SEQ ID NO: 1092 - DNA, 100 bp, Artificial
  Synthetic
ggcgcggatttcgcggccaaaatcggtcagatctctgcaatgacgcacaccgctgacatcgcaaaaggcctcatcgatactgtaaatttcgcagcgcggg

SEQ ID NO: 1093 - DNA, 100 bp, Artificial; identical to SEQ ID NO: 1016
  Synthetic

SEQ ID NO: 1094 - DNA, 100 bp, Artificial
  Synthetic
ctttgccgttgccggtaaagaccatcacaatgccgcgctcgtcctgggccgccgccacccgggcgtcaactttatctttcagccgctgctggcgttcgcg

SEQ ID NO: 1095 - DNA, 100 bp, Artificial
  Synthetic
tggcgttgaccgcctggccgttgacgctggtcagcacgaagcgatgatgctgcagctgttccgcaccggtggacaccttactgttatagacacagccgga

SEQ ID NO: 1096 - DNA, 100 bp, Artificial
  Synthetic
gctcattgctctgcttgagcttctgcgcaatctccgtcagcttgcggctgcggatgtactggccgagggaatggccggtctctttcttaaacatacgttg

SEQ ID NO: 1097 - DNA, 100 bp, Artificial
  Synthetic
atacatacttcgcaacgaatggagcagagcacgcgaaactgggtcgcggtaatatccataggtgagaggtagtcattgagcaggcgatcttttttctggt

SEQ ID NO: 1098 - DNA, 100 bp, Artificial
  Synthetic
ggagggagcggtttgccgcgggcgacatttttggcgatacccggcggcagcgcctgatagccgaccagaccgtagttcacggcaagggagcgcgcccgtg

SEQ ID NO: 1099 - DNA, 100 bp, Artificial; identical to SEQ ID NO: 1024
  Synthetic

SEQ ID NO: 1100 - DNA, 100 bp, Artificial; identical to SEQ ID NO: 1018
  Synthetic

SEQ ID NO: 1101 - DNA, 100 bp, Artificial
  Synthetic
ggtgcgcaccaccgggacgccggccaggcgcgccgcctcttcattgccgccaatagccagcgtattacggccaaaggtggttttgtttagtaataatccg

SEQ ID NO: 1102 - DNA, 100 bp, Artificial; identical to SEQ ID NO: 1019
  Synthetic

SEQ ID NO: 1103 - DNA, 100 bp, Artificial
  Synthetic
gcggctgagggtcatcaccaggccatgatgcagccccacgttacgggtgacgcagaaattttggttgttacaggtgaccagccagtcgttgaagcgctgc

SEQ ID NO: 1104 - DNA, 100 bp, Artificial
  Synthetic
gggtatctttcagcgcgaagcgcgcgcacaggtcggcacgggtggcgccgcgacgcaccatgtcggcttccgctctgccgccgaggcacagccccagcgc

SEQ ID NO: 1105 - DNA, 100 bp, Artificial
  Synthetic
  misc_feature (1)..(30): n is a, c, g, or t
nnnnnnnnnnnnnnnnnnnnnnnnnnnnnnggatgaataactaacgctgttcgccccatgcgcgcttcgcggttcacataaacataattatcgccgcggc

SEQ ID NO: 1106 - DNA, 100 bp, Artificial
  Synthetic
cggcggtaggggcgaggatcagcgtcgccagtccttcgaaggtgatggcgtggataacgcgttcggtgagcgtcttgcgctgatgtggggtctgttgcat

SEQ ID NO: 1107 - DNA, 100 bp, Artificial; identical to SEQ ID NO: 1021
  Synthetic

SEQ ID NO: 1108 - DNA, 100 bp, Artificial
  Synthetic
tcataacgcccctgatcgccgcggatgcgcagccccatatcgtgacgacgcagccagttatcggcggtttcgtaataaatgttcagcaactggcccgcgg

SEQ ID NO: 1109 - DNA, 100 bp, Artificial
  Synthetic
cagttcaccacgaaccactttgcctgagggcagctcgctaaagtcagcgggcagcagctggctcagtgggcaaaactgaatttcttcttccgccgccatg

SEQ ID NO: 1110 - DNA, 100 bp, Artificial
  Synthetic
tgccttccgcctcggcggcttcggtgagcatgcgcgcggaatcgtcgctgctgccatcgtcgatcaacagaatttcatattgccgccccagggtggcgca

SEQ ID NO: 1111 - DNA, 100 bp, Artificial
  Synthetic
tcagattgtcgttatcgacatcgatcatcaccggcgtggcgcccagcaggcagatcatattgagagtggagacccaggtctgggacggcgtaatgacttc

SEQ ID NO: 1112 - DNA, 100 bp, Artificial
  Synthetic
atactgggcgattttgaaatagataattagcccggtgccatcaatcagcgtggcgataaacggcgcggaaactaccgccgggtcaatgccgatccgctta

SEQ ID NO: 1113 - DNA, 100 bp, Artificial
  Synthetic
gccggttttatcctgaccatccacatcaatgccgttatccagcatggctgcgatcgtcgctggcgcatcgtatttacaggccagcaggaactggctggtc

SEQ ID NO: 1114 - DNA, 100 bp, Artificial; identical to SEQ ID NO: 1022
  Synthetic

SEQ ID NO: 1115 - DNA, 100 bp, Artificial
  Synthetic
gtcattatcgccgccagcgttttttcccagctaaacgacagcagcatgacctcaaggctgaacaacgccccggccagcgggacgttatagaccgccgcca

SEQ ID NO: 1116 - DNA, 100 bp, Artificial
  Synthetic
cctttaacagccatgagaggacaaacgccaccgccataatgccggccgccatcagaaacgccgcgtggatcgccgcgccgaaggcgtcgaggtagtcgag

SEQ ID NO: 1117 - DNA, 100 bp, Artificial
  Synthetic
ctggcgcagaatcggcatctcgccgatgatctcctgcatccacagcggcgcgaaccaggcgtttttctccgccatatgccccagcgtctcgaccatcatc

SEQ ID NO: 1118 - DNA, 100 bp, Artificial
  Synthetic
tgacgccgatcgccgcgtacattttatcgccgctggctttgacgatagcgttccagctggcgtgcagcagggcggcgaacagcaaaatgcagaatacggt

SEQ ID NO: 1119 - DNA, 100 bp, Artificial
  Synthetic
ttcttatcttcgcgatagatacgtaccgcttcgtcgagatccatacgcgcaaacgcatccagtacgtcatgcagcatctgcaccgtgtggcggcccagcg

SEQ ID NO: 1120 - DNA, 100 bp, Artificial
  Synthetic
cttcagcatgttttcggtggtacgaataacgataggcacctgcagcagcgccagcgcgataacgcccgcccagcccgagaagtgctgcatctgcgccacc

SEQ ID NO: 1121 - DNA, 100 bp, Artificial
  Synthetic
aatgctcggccaggaagagatgatcagggaaacgatgatgccgcccagcatcaatagcacaatcagcgcagccagttttaccagcgcactgaaaatcatg

SEQ ID NO: 1122 - DNA, 100 bp, Artificial
  Synthetic
catcagccagcggagcatcagaagcaccgaaatcaacggtgttggcaataatctgcttaacgccaccagaggaaccaataccctggtagttcactttatt

SEQ ID NO: 1123 - DNA, 100 bp, Artificial
  Synthetic
ggaactcaatcacgtcatcttcaatgccaatctgctccacatcggtggcgtagcccttcttataataggcgcgatactcctccacgctcttgccgccggg

SEQ ID NO: 1124 - DNA, 100 bp, Artificial
  Synthetic
ctgaataaagacctcttccacccagcgtttgccacagaagacgccatcttcacgagtaatgaccaccgcatgggagcgtgcatcctgcggcaataattgc

SEQ ID NO: 1125 - DNA, 100 bp, Artificial
  Synthetic
gcatcggattgacgaaaatactgaccaccaccacgtccgcactggctttggcttcatcaaccagcttcatatgaccatcatgcaggttgcccatcgtcgg

SEQ ID NO: 1126 - DNA, 100 bp, Artificial
  Synthetic
tagcgatcagctcgcgaattttgcgctgacagttttcgataaaggtggcgatgatattcagcagggcgtgttccagcgtttcctgggtgcgctcgggcag

SEQ ID NO: 1127 - DNA, 100 bp, Artificial
  Synthetic
gggtcgataaaattggcgaagccgcgcttcaataccaccggccgtttttgccagtagcgttcgataaagtcgggccagttaagcgttaattgataatcca

SEQ ID NO: 1128 - DNA, 100 bp, Artificial
  Synthetic
aaaacgacgcgtttgcccgtcggcaatgcccgcgtcttcggcaaaagcggcctgactgaataaggaagcgactcctgacgttccgcatacggcggcaaca

SEQ ID NO: 1129 - DNA, 100 bp, Artificial
  Synthetic
ccggcgtgcttgcgcagcagcggcgaacgctgggtcagcagcaggccgggctgcggccggcgcacgatcggcaccagcaccgccgcctgccgctgattga

SEQ ID NO: 1130 - DNA, 100 bp, Artificial
  Synthetic
gctccagaccgcggcgccagcgttccgcagtggtattctgatgacagcgcagggagatatggtcggcgtcgagcccggcgatctccagtcccagtcgcgc

SEQ ID NO: 1131 - DNA, 100 bp, Artificial
  Synthetic
tgccgggtatcagattaagcatagcaaatgcccctttgaggcggtgggcggtttgcgccagagcagcaaaatcgcccgcttcgatttcagtatacaatct

SEQ ID NO: 1132 - DNA, 100 bp, Artificial
  Synthetic
gttgctcgaacagcatgcccgactcgaaggcgttaaggctcagcatccgttggcaaaagccgtggatggtgaataccgccgcctcgtccatctgccgttc

SEQ ID NO: 1133 - DNA, 100 bp, Artificial
  Synthetic
aacagcacgatcgctttgatgacgcagagaataaatgccaccagcagcgaggcgctgtcaatcggccccattgccgggataatccggcgcagcggtccga

SEQ ID NO: 1134 - DNA, 100 bp, Artificial
  Synthetic
tggtcgctaactggaacgggatcgcaaagccaatgccttccggcgtttcgccgtcattgctcttgtcaaaggagagggtgttaatccccatcagctcgcc

SEQ ID NO: 1135 - DNA, 100 bp, Artificial
  Synthetic
agtttgccgagatcgcgcaggtgcacgtgcccggggacaaactgggtaaaggagttaacgacggcgataatcggtttgccgaaatcggcatcggtcattc

SEQ ID NO: 1136 - DNA, 100 bp, Artificial
  Synthetic
cgcgtaaagccgccgtcgccgcacagcttgccgctgttcatcgcagactgcatgtaatcaagctcggttccaaccaccggcggcgcgttaaatgggatca

SEQ ID NO: 1137 - DNA, 100 bp, Artificial
  Synthetic
agatcacgaggaaaaacaccacgcgggagccgaacgaatccagcccctcgcgcgccagcactatcatgttgaagatagcgccgaaacagaaactgtgcag

SEQ ID NO: 1138 - DNA, 100 bp, Artificial
  Synthetic
catatacagcgcgtgcggatacaggcgccggcagtcgcgcataaagatctcctggcgcggcgaccccatcgcgacggtgacgattttcgccccgctgtcg

SEQ ID NO: 1139 - DNA, 100 bp, Artificial
  Synthetic
tgccaagaaattgttcgagaacagcctggcgacgcaggttagaactgatatagaagttgagcaaacgcgacagcggcaaatagatctcggcaacctcttc

SEQ ID NO: 1140 - DNA, 100 bp, Artificial
  Synthetic
cgcgccaacgttagtgtcatagaggaacttacgccgcgagctgctggccgcatggcgcagctggtgatagtaatccagcgaagaggtattggcctttttg

SEQ ID NO: 1141 - DNA, 100 bp, Artificial
  Synthetic
aaagccgaagaccaggaacagggccacggcgctgaacacttcgcgcaggccggaacgggcgacaaagcgcagcagcgggcgggtcagatagcgcccaagg

SEQ ID NO: 1142 - DNA, 100 bp, Artificial
  Synthetic
ccgtcggccaccatcactttgaaacgggtggtcgccccgttgtccagggtctgtttatgttcgaggttcatttccacataggtgtcggcctggttgccca

SEQ ID NO: 1143 - DNA, 100 bp, Artificial
  Synthetic
cgttgatgcggaagctgttatccatatggggatcgttgatgagccctttccagccgacggtggtgcgcggtttttcaaaatagacccgcatgacgatctc

SEQ ID NO: 1144 - DNA, 100 bp, Artificial
  Synthetic
actggctgtgcgcggtttgcgccacgctcattttctgttccagcgacagcattttctccgtcgcttcctgctctttcgcctggaaggtttccagccactc

SEQ ID NO: 1145 - DNA, 100 bp, Artificial
  Synthetic
tcagctttctgatcgacgctacggttagagctggagtagcctgcagacagtgcgataccgttgtcgaacgcgtaggtggctgcggtgctgaagccgtcgc

SEQ ID NO: 1146 - DNA, 100 bp, Artificial
  Synthetic
ggtccagacgtgctcgccgaccatttttccatagaagtccagtttgttgccgtttttgttatagatttctgcagcgttggctgcaccggctaccagcagg

SEQ ID NO: 1147 - DNA, 100 bp, Artificial
  Synthetic
ttccactggaatacgatagtcatcgttcaaacgctgcttcagccccggaataaagaacggcactttgccgacggtgcccagacggataccgcggaactcc

SEQ ID NO: 1148 - DNA, 100 bp, Artificial
  Synthetic
cccgccagaatggcatggataacgtacaggatcggcgccacgaacatgaacgagaactcgatcggctcggtgataccggtcaggaacgaggtcagcgcgg

SEQ ID NO: 1149 - DNA, 100 bp, Artificial
  Synthetic
ccagctgcccatgatgaagcccatcagacgctgaggaaccagctgagcgaccatcgccaggccgaggccggaaatcatcagttcaccgatagactgcagc

SEQ ID NO: 1150 - DNA, 100 bp, Artificial
  Synthetic
gacgtgcagcacgcttggttttggtaccggctttaacggcagccatggtgctcagcagttcattcggatcaataccgtcagcaatcagcatttcacggta

SEQ ID NO: 1151 - DNA, 100 bp, Artificial
  Synthetic
tcaccagcgcggcgaggatcaagccagccggcaggaaaatgcgcggattcgagcggtcagagaccgatcccatgatgaatttcgaaaatccataggcgat

SEQ ID NO: 1152 - DNA, 100 bp, Artificial
  Synthetic
gcgatcagcaccagcaggtagaactcttctttgttgtccttgtaaccctcaagccacgggtaggcgaaagtacaggtcgcgaggctcgccagcagcacca

SEQ ID NO: 1153 - DNA, 100 bp, Artificial
  Synthetic
ctggcgcaggaagctgccaaacagcgggtgatagcggaaccattcgccggaatcatccatccgctgcaggaacagcccctggcgttcgatctcctccagc

SEQ ID NO: 1154 - DNA, 100 bp, Artificial
  Synthetic
gtcagcaggcgaataccgcgagaagcgccggagacgatctcgatcgcgcctttacgcgccagcgctttcaggtgttcttccgccgcgtttggggaacgga

SEQ ID NO: 1155 - DNA, 100 bp, Artificial
  Synthetic
cccgcgccaggcgtttttcagcatcgccagcgacacgccgcgcagcgtcagcacccgcttcgccatcagcaggccaataatgagggtggcgtactccgcg

SEQ ID NO: 1156 - DNA, 100 bp, Artificial
  Synthetic
tacggcatcaaagaattcacgcgcctcttcaatggtcatatccagcacttcgtggatggtcttacccttgtacttaatctccagcgtttcgcggttatag

SEQ ID NO: 1157 - DNA, 100 bp, Artificial
  Synthetic
atactcaccagcgacttccgccagtttgccgaacagcacaacgcggtgccactcggtctgctctttcatttcgccggtctgcttgtcacgccaggattcg

SEQ ID NO: 1158 - DNA, 100 bp, Artificial
  Synthetic
ccattgacccggcgcagggtacgcaggtggatcacgttctcgccctcattgatgccaaaggcctcggcgacatgggcgctggcggggcgcagcaccgaca

SEQ ID NO: 1159 - DNA, 100 bp, Artificial
  Synthetic
agccttgtttgaccacgttgatcatccaggggacgccaaagcggtcgacgactttgccgaagccgtgggcccagaaggtttcctgccaggccatctcaat

SEQ ID NO: 1160 - DNA, 100 bp, Artificial
  Synthetic
tcgaagagctgcctttaaccttcagatctttcacgacggtaacgctgtcgccatcggccagtaaattgccattggcatctttaacgatcagaatgtcgct

SEQ ID NO: 1161 - DNA, 100 bp, Artificial
  Synthetic
ccagcggcgggtacggcgcttcgaaatcgatcttgtcgtacgggttgaccttcttctccacgtcgaggtggaagctgttggtgtagtaacctttgtcggt

SEQ ID NO: 1162 - DNA, 100 bp, Artificial
  Synthetic
tattgtagcaaagtcatcgttgacgaagggcaggatcccttccgccaccggctgcaactgctttgttaaatagtgatcgtaatcgagcggcgactgctgg

SEQ ID NO: 1163 - DNA, 100 bp, Artificial
  Synthetic
gcgcttacccaattcgccgcgataatacagctggacagcaataaaccggaaattattggtaactttcgactgatgttgacggagccggttcgcttcaaca

SEQ ID NO: 1164 - DNA, 100 bp, Artificial
  Synthetic
tccacgcccaccgatttacgctgccgatcgttatgaatttcccgctcatcaatcccgtggctgcgctcccacagaatacgcccgaatttaccgaagcgct

SEQ ID NO: 1165 - DNA, 100 bp, Artificial
  Synthetic
tggcgcgcttggtcataaagttatcggtctgggcagaggaatcgccgccgaattccgggaacatatcggtccaggcttccacgtcgtacagggcgccaag

SEQ ID NO: 1166 - DNA, 100 bp, Artificial
  Synthetic
ccctgcatttcgatcacctcttccaccgccatcggtgaaatacggcgcatcaccgctttgattcgcgccaccagctctttcggagagaaaggcttggtga

SEQ ID NO: 1167 - DNA, 100 bp, Artificial
  Synthetic
ccagcacgtcaaactcgccaagacgcaggtcgcggatgatttccatgcgctcgacggtgtcgatatccgagtgcagatagcgcacgcgctcgccgtgctc

SEQ ID NO: 1168 - DNA, 100 bp, Artificial
  Synthetic
gttggtgttagcggaagtaatgctgtagccggtcgcgccagcggcttcggctttagcagccagttttgcttccagaccatctaaagtggttgcgccttgc

SEQ ID NO: 1169 - DNA, 100 bp, Artificial
  Synthetic
acttgtagataacggcggtaccgtgaagggtattcggaccggttaccgaagtaatacggtatgaagtggcgcccatctcatccgctttctgcgccagctg

SEQ ID NO: 1170 - DNA, 100 bp, Artificial
  Synthetic
tctttttcatgcttgctggcgtcggtgttgatcgccggcagcgtcatcatcggcttcacccgcacttccgcctccgggaaaatgcgctgcatgcgtttgg

SEQ ID NO: 1171 - DNA, 100 bp, Artificial
  Synthetic
gctttgacaaaataggtcgcgctgggatgctgcaccagcagctcgttgaggtcgattcgcttctcaacatagtcctgagccgggctgggaaagccgcact

SEQ ID NO: 1172 - DNA, 100 bp, Artificial
  Synthetic
cgtggcgcggatttcgcggccaaaatcggtcagatctctgcaatgacgcacaccgctgacatcgcaaaaggcctcatcgatactgtaaatttcgcagcgc

SEQ ID NO: 1173 - DNA, 100 bp, Artificial
  Synthetic
ggccggtcgtccgcaagtagccaggcgcagagctgcttgttacgccgtagccgcttgttaaacagcggctgctgctctttaatcaaccgcgcctccagca

SEQ ID NO: 1174 - DNA, 100 bp, Artificial
  Synthetic
cagctgtcaggcactttcagatagaacagcgtcagcgcgccaaagacggccagcaggctgtgggtgaagccgcggtggccaaaggcccgcgccacgggct

SEQ ID NO: 1175 - DNA, 100 bp, Artificial
  Synthetic
gctcatgcagggtgcccatcatccgcgggtggttggtgcccggattatggccgatggagatcaccagctcggtctggtcaaaatcgtcgagggagacggt

SEQ ID NO: 1176 - DNA, 100 bp, Artificial
  Synthetic
tcgttctcgaaaatttccaccccctgataccccgccgccgcaatagcgtgcagcttctcaggcagggtgccggaaatcgaaacggtggcgatagagcgca

SEQ ID NO: 1177 - DNA, 100 bp, Artificial
  Synthetic
ttcgccagcatcgtgcccatttccggcaggccggtcgaggtcattatcatggcgataataatcgaggagatgaccgccagcacaatatcaacgccgatca

SEQ ID NO: 1178 - DNA, 100 bp, Artificial
  Synthetic
ccagatcgagcattttgtcgtaagcgtcggcctcttttttgctggcaaaagacattttttcctcaccttcgcggatcaccacatatttaatttcaaccgc

SEQ ID NO: 1179 - DNA, 100 bp, Artificial
  Synthetic
tgcaaccacgtccttacagcggcggcatccgccaaccgccaatgcgcctgagtttccccggcgccaacttttaccgacattccctgcagttgattaacga

SEQ ID NO: 1180 - DNA, 100 bp, Artificial
  Synthetic
cggacgggaagcgcgtcggatcgtagttagtgttggcagagatcgactggtcgataaacttctgcatgatacccaccagctgcagataaccgtcgttgtt

SEQ ID NO: 1181 - DNA, 100 bp, Artificial
  Synthetic
ctgcgccgccagcacgaacaggtcatagcactcctgcttgcactcttcggcgatttccgccatttccggatcgtcgctgccggagcgcagcaggttcagc

SEQ ID NO: 1182 - DNA, 100 bp, Artificial
  Synthetic
tcacttcgccatttttgaacatcataatggtcgggatgctgcggatacgaaaccgggcgctaagctcacgttccgcttcggtgttgactttcacaaaacg

SEQ ID NO: 1183 - DNA, 100 bp, Artificial; identical to SEQ ID NO: 1104
  Synthetic

SEQ ID NO: 1184 - DNA, 100 bp, Artificial
  Synthetic
tgctgttgcgtcataccgacacgaatttttgctacatcgtttggtgccagatagttaccctggttgatgtcaggacggtaaaccactcgttccagagtgg

SEQ ID NO: 1185 - DNA, 100 bp, Artificial
  Synthetic
ctggatatcttccatcaggtagccgcggtaaagcaggaatcgctgaactttcactttttcagtaaaggcggaaggtaacggttcgccgtatttacgctgt

SEQ ID NO: 1186 - DNA, 100 bp, Artificial
  Synthetic
ccaccggtagtggtttccgggttaccgaacatcacgccaattttcatacggatctggttgataaagatcagcagcgtgttggactgcttcaggttacccg

SEQ ID NO: 1187 - DNA, 100 bp, Artificial
  Synthetic
tcctgggcgcagatgacgccgatgcagccggtggactggctgagcaacgactgggctatcatgtttggccggtaattgagcgcttccgccgcctgcagca

SEQ ID NO: 1188 - DNA, 100 bp, Artificial
  Synthetic
gcgcccagcagcgtttcgcccggcgcgttaaagcggtttttgccgctctgccagttttccgccaggcggcgcagcatattgaaatgctgttcaaggcttt

SEQ ID NO: 1189 - DNA, 100 bp, Artificial; identical to SEQ ID NO: 1118
  Synthetic

SEQ ID NO: 1190 - DNA, 100 bp, Artificial; identical to SEQ ID NO: 1122
  Synthetic

SEQ ID NO: 1191 - DNA, 100 bp, Artificial
  Synthetic
gatgatctcctgttcaaggacatcgagatattgatcggccttatgctgctggcgggtgactatcttattgcagccgcagaaataacacagcttatggcaa

SEQ ID NO: 1192 - DNA, 100 bp, Artificial
  Synthetic
gcgccagcgctaaaaacgatggtgaccatagcttcagcctgcgcttcggtaaaggcgcgcggcatatggttttcgagttctaaatagtcggcgagttccg

SEQ ID NO: 1193 - DNA, 100 bp, Artificial
  Synthetic
atcgaggcatagcgattggagacaaacgcgtcgcgcggatcgtcgcgctcgcagatagtcaccagccccaggccctccgggaattccaccggcacatctt

SEQ ID NO: 1194 - DNA, 100 bp, Artificial
  Synthetic
tgtcggtcacgttacgcagaccgaaagagatggtgatgcagtcaaaggtattatcagcaaaaggcagggcttccgcgttggcctgaacatactcaacgtt

SEQ ID NO: 1195 - DNA, 100 bp, Artificial
  Synthetic
gcgcgaatactcttcaccaggttgctgccgctaaactgcagcggtagtccctgcaatacgccggtctgcttgatatccagcgccaccagacgtttaccct

SEQ ID NO: 1196 - DNA, 100 bp, Artificial
  Synthetic
cagccaaggttgccgcgcaccacaaagcggtggcggtcatagagggtacggatccagacgtcctgggcctgcatcacgatgaagttgatgtccgagcccc

SEQ ID NO: 1197 - DNA, 100 bp, Artificial
  Synthetic
ccgcgcgtggtcaccgcatcgggaaaataaccgtattctttctccgccaacgtaaccgatttcacttcaatatagcagttttgtcggtcatctgcctgta

SEQ ID NO: 1198 - DNA, 100 bp, Artificial
  Synthetic
taccatagtgccgttaggtgccagacttggcgtttcgtctaaaaacgttgatgacagaacctgtacaccacccgtttccagatcttgtttggcaatgtgc

SEQ ID NO: 1199 - DNA, 100 bp, Artificial
  Synthetic
gcagctcagcgcggacgcgctccagatcttccggggtatccacgccggtgccgggcacttcggccgccacggcgacatggattttctcgccataccacag

SEQ ID NO: 1200 - DNA, 100 bp, Artificial
  Synthetic
agccagcgcttgagcatccggctacccatcggcgtcaccgtacagtcgagtaccgaggccagggtgttgtcggtgccgccggccagattctgggtgatct

SEQ ID NO: 1201 - DNA, 100 bp, Artificial
  Synthetic
gctaatctcgcgcaggatcacggtaaactggttgcctttcagcgcgcctaaacgcagcttacgcttatggcgagcatattccagtacctggcagccctcg

SEQ ID NO: 1202 - DNA, 100 bp, Artificial
  Synthetic
cgtttttcccggcatagctaaagaagttgagcggcgaaccatcgccaaagtcgatatagccgctgccctgcacgtccatgatgaagttatccatcaacga

SEQ ID NO: 1203 - DNA, 100 bp, Artificial
  Synthetic
gcagcccgggtccgcgcagtgcatgcagccatccttgcggatgagccattccagcttgtcgttttgttccacctccgagaagcgcatgaccgtccatgac

SEQ ID NO: 1204 - DNA, 100 bp, Artificial
  Synthetic
cagccgacgacaagcggtgccatcctcacggaataaatggcaacgttctggcggcaaaccgatagcgaatgtggctccctcttctaccaacaccacgtcg

SEQ ID NO: 1205 - DNA, 100 bp, Artificial
  Synthetic
agttttcaatcgctcgcagagtatgaacgccgtagtaagcgtccgcgggaacttccctggtgcccaacagatcttcttcgatacgaatgttgtttaacat

SEQ ID NO: 1206 - DNA, 100 bp, Artificial
  Synthetic
ccatggtgtagtgcgcggtcgggcgcaccgggatcggctctttcaccggatcgacgccgacgtaggctttcgccagttcacagataaacggcagacgctc

SEQ ID NO: 1207 - DNA, 100 bp, Artificial
  Synthetic
cggcactacgtgaacccttcactaaaatggtcattattttgtgctccgccagcagctcgcgcaggcgagccaccacggcggctttatcgttaaaatgttc

SEQ ID NO: 1208 - DNA, 100 bp, Artificial
  Synthetic
aaggcgagtttttgcagacgggcgatcatgcgcgggcccatccacaacgagatgaacagcgcggtcagcaggctgacgatggcgcgaaacgtcagatatg

SEQ ID NO: 1209 - DNA, 100 bp, Artificial
  Synthetic
gtaaatccgcagcttcgccgcgcgatactgctgcagccccagcgggtagcggtccatatggtcctcagtcacgttgaggatggttgccgccaccgcctgc

SEQ ID NO: 1210 - DNA, 100 bp, Artificial
  Synthetic
gtgagccaatcagcgtgccgtagacggagtggcgtttcatgtacaggctgtagacgccgacataaaccacgaaccccatcacccccagccagcaggccag

SEQ ID NO: 1211 - DNA, 100 bp, Artificial
  Synthetic
aaccttcatcggacttgctgttcatatgcaggaagtacacgaggtgtaccacgatctgcaccacagcggtcaccagaatggtgccaaggataaccgcatg

SEQ ID NO: 1212 - DNA, 100 bp, Artificial
  Synthetic
cacacgacgtccaggaagtgccagaacaggctcaggcacaggatacgcgtgcggttagtgctggtcaggccacgacgtgaaacctggaacatcagcaccg

SEQ ID NO: 1213 - DNA, 100 bp, Artificial
  Synthetic
tggtagaggcgctaattgcgaacggcgcaccggacgcggccatctgagaagcaggatacataccggcgataacctgagtcgcggcgatgtagacgatacc

SEQ ID NO: 1214 - DNA, 100 bp, Artificial
  Synthetic
gttctgcgttaaacacgcgagcgatatactcttccgcttctttgtgcgggccgctgtggtccagcagggaacccagttcagaaaccgaaatggagatatc

SEQ ID NO: 1215 - DNA, 100 bp, Artificial
  Synthetic
acatgttgcgccagcgggtgtcctcgatcttggaacggtagtcaaaaccgaccggacggaagaacagcgaggccagcaccagaatcatcgccacatagaa

SEQ ID NO: 1216 - DNA, 100 bp, Artificial
  Synthetic
cgatgtagatatccaggaagctggaggtacgaccgaaggacattgccgcgccgttctgagatttcacggcagccaggtaaccgaagtaggtccactgaat

SEQ ID NO: 1217 - DNA, 100 bp, Artificial
  Synthetic
gctttatccatcaggctacgaccggaatagctcatccatacggcgagacaaaccatcaggttagcgaggatacccaggctcacggcctccacaaaagtat

SEQ ID NO: 1218 - DNA, 100 bp, Artificial
  Synthetic
aacgttttcagagatggagttaccaccccaggaaccacaacccagagtcagggaaggcgcgagtttgaagttgtacaggtcaccgataccaccctgagaa

SEQ ID NO: 1219 - DNA, 100 bp, Artificial
  Synthetic
tcgccgcctcgcgcatcgcctgcgcttcgctgccgccctgggccttcacgcggtccatagtcagcttacggaagatcacggagatcatctggaaggtgga

SEQ ID NO: 1220 - DNA, 100 bp, Artificial
  Synthetic
ttccaggatatctttgcgtaactgcggcaggtaatgcggctccgcgtctccgcggcggcgctcggcgacgatgatttgcaggcgttctttcgcaatatta

SEQ ID NO: 1221 - DNA, 100 bp, Artificial
  Synthetic
catcgactgaaatcgcgttgttaacctgggttttaccctggcggaacgccataccgccgatgttgacgctggtgattttcacgccgccctcgacgatacg

SEQ ID NO: 1222 - DNA, 100 bp, Artificial
  Synthetic
gtcgtatttttgctgatcgtagcgggccacgttaaccggctggccaaaaaacatgggttccagcagctgatcgtttttcgtctgtgaaaaagtggtgtat

SEQ ID NO: 1223 - DNA, 100 bp, Artificial
  Synthetic
ccaagaaccgacagcgtggcattgagaaaatgattgcgtcgccacgcaatggagagcatcacaaccaccaccgtcaagccgacgatcagcagcggtagca

SEQ ID NO: 1224 - DNA, 100 bp, Artificial
  Synthetic
agaacaggaacatgtcgatggcgaggaacacgccgataacgccgcccaggatccacatcaggttgaggtggaagaagccctggtatttttcgatttcacg

SEQ ID NO: 1225 - DNA, 100 bp, Artificial
  Synthetic
ggaatggttttacgaacaccttgtcgtataaccagtcgaagccccaggcatggaaccaccaggtaccgaagaagcggccaggcgcactgttggcgatgga

SEQ ID NO: 1226 - DNA, 100 bp, Artificial
  Synthetic
gacgtacggcccaaacagcgcaatgcccacttctttggcgttaatcgccgcaccgtcgataccctggtcgttaatgcccaggatggcgtaaacgataacc

SEQ ID NO: 1227 - DNA, 100 bp, Artificial
  Synthetic
tcttccggatacatccgggtttcacgtttggcgaaggcatgcaggccaatcatccagatactacggacctgggtgccgaaccccaccaataattctttta

SEQ ID NO: 1228 - DNA, 100 bp, Artificial
  Synthetic
ggcacgatagcgaaggccagcagcagcgaggtaaaggcgataaccggcgccagagtaaagatcacgcgatcggagaagcgcgggatccagtcctctttaa

SEQ ID NO: 1229 - DNA, 100 bp, Artificial
  Synthetic
ggtagcaggcgatgcagcggttcatttcgtgcgaaataaacggccccagatcctgattgcggtgggtacgcttggtgaaacgatagcggcggaagctatg

SEQ ID NO: 1230 - DNA, 100 bp, Artificial
  Synthetic
tcccagacgcccggattcttcacccggccggagaagcccatcagcttggtgccagcatctttgctggtggaaatgttctggtaccactcgacgccgttgg

SEQ ID NO: 1231 - DNA, 100 bp, Artificial
  Synthetic
caggaattgcctccggcgtcagatggctgtgagtatcctcatcaatcatcatggtcggtcccttgtcgcagttacccaggcagcaggtcggcagcagggt

SEQ ID NO: 1232 - DNA, 100 bp, Artificial
  Synthetic
cggaagaaccggaaccgccgtggaacacgaagttcaggctgttgtgcggcaggttgtgtttcttggaaacatattcctgagagtcgcgcaggatggtcgg

SEQ ID NO: 1233 - DNA, 100 bp, Artificial
  Synthetic
atatgcagcttacgacggtgctgatgcacaaagctgacggcttcctgcagtttcttttcggtgaaattaaggccggcaaagtggcgggcgttggtgtcat

SEQ ID NO: 1234 - DNA, 100 bp, Artificial
  Synthetic
tgcggcaggttacgcgacaggaccaccagggtcatattctccggctgatggcgcaggaaaaagcgcatcgcgtcatggatcaccggattattgatcagat

SEQ ID NO: 1235 - DNA, 100 bp, Artificial
  Synthetic
aacgatgcgaatcataccaggcttaatggcggtgagcagcggcgcgtggcccgggtaaatacccagttcaccttcgctacccgttacctggattttttcg

SEQ ID NO: 1236 - DNA, 100 bp, Artificial
  Synthetic
gcgcggatacttcagtaccggccagggtgtaacgatagatgttatcgacgaacagcagtacgtcacgaccttcgtcacggaatttctcagccatggtcag

SEQ ID NO: 1237 - DNA, 100 bp, Artificial
  Synthetic
aaatttgttgctgacaacgtacagcttgtccagacggccttcatcataggcctgcaacatcacttttaccgggccgatcagttcggacagggatgggtta

SEQ ID NO: 1238 - DNA, 100 bp, Artificial
  Synthetic
agtatcctgactttctggcgactatatcaatgttaagtggttgatcgatatgttcatcaatccattcaatcaaagtttgaataatatcctgatgggacat

SEQ ID NO: 1239 - DNA, 100 bp, Artificial
  Synthetic
ggaacacccaccacatcaggccgaaggtgaggatatcgaaaatcgagctgatcggtccaaagaagaccataaagcgcccgagatcggccgggttccagcg

SEQ ID NO: 1240 - DNA, 100 bp, Artificial
  Synthetic
aacagcgcgataatcacgatagccccgaggtcatcaataatcgccagcgccatcaggaaaatcttcagcgccgtcgggacccggctacctaacagcgcca

SEQ ID NO: 1241 - DNA, 100 bp, Artificial; identical to SEQ ID NO: 1077
  Synthetic

SEQ ID NO: 1242 - DNA, 100 bp, Artificial
  Synthetic
gtaatacggtatgaagtggcgcccatctcatccgctttctgcgccagctggtcttccagcgagcccaggttagtcccggcagaagcagagatggtgccta

SEQ ID NO: 1243 - DNA, 100 bp, Artificial
  Synthetic
tgcgcaatctccgtcagcttgcggctgcggatgtactggccgagggaatggccggtctctttcttaaacatacgttgcaggtgccacttagagtaaccgg

SEQ ID NO: 1244 - DNA, 100 bp, Artificial; identical to SEQ ID NO: 1097
  Synthetic

SEQ ID NO: 1245 - DNA, 100 bp, Artificial
  Synthetic
gtacggcattttcatgttcgcgcagacaggtgacgcgtaagacatagcgtttctcttcgtcaccggcccccggcaaggcatgaatgcgctgcgccgcctc

SEQ ID NO: 1246 - DNA, 100 bp, Artificial
  Synthetic
cggtcatgctgctggattggatccccgtgaggcttaacaccagcccgaacacgaccatcactgccaggttcgtcagcaggaaaagcgcgattcgcatcat

SEQ ID NO: 1247 - DNA, 100 bp, Artificial
  Synthetic
gcatttcatgcatatccatcggggaagatgctaccgcgccgacggaaaccgtgccgatggcctcgcggccctgggcctgctcgctgttgataatatcagc

SEQ ID NO: 1248 - DNA, 100 bp, Artificial
  Synthetic
actgggcgattttgaaatagataattagcccggtgccatcaatcagcgtggcgataaacggcgcggaaactaccgccgggtcaatgccgatccgcttaag

SEQ ID NO: 1249 - DNA, 100 bp, Artificial
  Synthetic
tgagcaacgactgggctatcatgtttggccggtaattgagcgcttccgccgcctgcagcaccgcctgacgactggcttccttcacgccacgtgagccgct

SEQ ID NO: 1250 - DNA, 100 bp, Artificial
  Synthetic
accagctggtggttgacgaaggcgcccagcagcgtttcgcccggcgcgttaaagcggtttttgccgctctgccagttttccgccaggcggcgcagcatat

SEQ ID NO: 1251 - DNA, 100 bp, Artificial
  Synthetic
gaaggcctggctcaccaacccctggtgcagccatgtggtctctttttccggctgctgcggcgtgcctttcaccaccagacgggtgccttccagttgaata

SEQ ID NO: 1252 - DNA, 100 bp, Artificial
  Synthetic
ccagctcgctttcagcaaagccagccaccgcgatagcgatgcgatagtggttttcgtctaccagctcgacgttatacggagggtagccgccgttgctctg

SEQ ID NO: 1253 - DNA, 100 bp, Artificial
  Synthetic
tgcccgcgacacgcaaataacacttcacatcagccagactactgccaccaaatttatgcagctgacgacctttcgcccctgcctgcgcaatcacactcat

SEQ ID NO: 1254 - DNA, 100 bp, Artificial
  Synthetic
cgtgcttacgctaatgccggtggtcttgctgacggcaacttccgcaccgtccgatttgcctgaggccaactccagcgcagtggaaactgcttcttccaga

SEQ ID NO: 1255 - DNA, 100 bp, Artificial
  Synthetic
ccgctccagagtcataacgcaaatcaacgtagctaatccgtttgccatcggtttgcgcctgctgctgtaaaaccggataaagttctacaaagcgagccaa

SEQ ID NO: 1256 - DNA, 100 bp, Artificial
  Synthetic
tatcactggtcacgacattgccagcataaggaattaccttagtgtggcgcaatgccccaccggtataaacggcgatatccattgtaccaccaccgatatc

SEQ ID NO: 1257 - DNA, 100 bp, Artificial
  Synthetic
cgccaagttttaactgaatataaggaaagccggtgcgcatccgcttgagaaagcctttattcaattgctcggcttcactcatcatcagcccgtggctgac

SEQ ID NO: 1258 - DNA, 100 bp, Artificial
  Synthetic
gccttccagattaaacagcgcctgatactgcttggtcagggcgtttttcggctctttgaggatctgaatcagagcttcttcgctcagttcattcaacgtt

SEQ ID NO: 1259 - DNA, 100 bp, Artificial
  Synthetic
acttcgactttgtcctgccagctttcacgggcggttaataccagaatcggcagtgaaacatcattgctacgccagcggcgaatcagtgacagaccgtcct

SEQ ID NO: 1260 - DNA, 100 bp, Artificial
  Synthetic
gtgtaccagggcgtaagcgtaaaaaacggtttacggtcagtggcaacgtggtgtcgagatacagcttctgcggtacatagccgatgcgcagttttccgtt

SEQ ID NO: 1261 - DNA, 100 bp, Artificial
  Synthetic
gcagtagcgcctccagttgcggatgcgccagcttcggttgctgttcccgccactgttcgtacatttgcatagtggtatccagcacccgtcgggcctgttc

SEQ ID NO: 1262 - DNA, 100 bp, Artificial
  Synthetic
cggaaacaaacgtcttgcccgctctcgtcgaccagatacagttccccttgcatacggcgaatacaatccctggcaatgcttaatcccagaccgctgccct

SEQ ID NO: 1263 - DNA, 100 bp, Artificial
  Synthetic
cggaggaaacagaatcagtgtgcgtcgctttcagctggcggatcgccgccatatcacgcacgccgtgaataaggttaacgaccgacttaccgacgctctc

SEQ ID NO: 1264 - DNA, 100 bp, Artificial
  Synthetic
aaatgacagtcataccaagatttttgcgggtaacttccagcaatgcgtcacgcagactggccgttttcttaacatgcgggatctcatcgcccgtatgcat

SEQ ID NO: 1265 - DNA, 100 bp, Artificial
  Synthetic
acaagtgagtgatccccaatgtggcacaacgatcttctaccagtttagcctttcgcccggtaatgatagcgacttcaatatcagaggtgagcgcacaacg

SEQ ID NO: 1266 - DNA, 100 bp, Artificial
  Synthetic
ttttgaattgctgaacgtaatgaggcactgacgcgagattcatcttccggtttagggtgcagctggcgattaactgcttcagtcaatgccgtcgctttgt

SEQ ID NO: 1267 - DNA, 100 bp, Artificial
  Synthetic
agatcgccgtagaacatcgccacgccaatgctacagtgcggacggagttgaatacgttcaatcggcaggcgctcgctcatgatagtgagcacttgctgac

SEQ ID NO: 1268 - DNA, 100 bp, Artificial
  Synthetic
aaaatccagcgcgcgataaaccgttggcggcttggcttgcggttcagcttcgcgcagcaaatcaagcagatcataagcgctgatagcgccatcctgcaga

SEQ ID NO: 1269 - DNA, 100 bp, Artificial
  Synthetic
gttcaccagatcaacatcaccgataccttctacgtctttcgctttagatttggtgtaagcgatggacggacgcagaccgaaatcgaactggtattgcgca

SEQ ID NO: 1270 - DNA, 100 bp, Artificial
  Synthetic
cgtcagaagacagctgatcgattttagcgttgctggagcaacctgccagcagagtagaacccaggattaccgcgcccagtaccagtttagtagctttcat

SEQ ID NO: 1271 - DNA, 100 bp, Artificial
  Synthetic
tcgcgctgctgttccggagtcagagagttaaagcgaactgcataaccggatacacggatggtcagctgcggatatttttccggatgcttaactgcatctt

SEQ ID NO: 1272 - DNA, 100 bp, Artificial
  Synthetic
cgctgcgaattaccgcctgactttctgcggtttgttgtttgaattgttcatgcgtggtgtaacgaatttcaatggtatttccctggtgtttttgcagctg

SEQ ID NO: 1273 - DNA, 100 bp, Artificial
  Synthetic
atgcattgtctccagttcgctaacattaacaggaggctgttcgtgccgggcctgttgcataagatctcgcatctgctgacgctgatgttcggttaaactt

SEQ ID NO: 1274 - DNA, 100 bp, Artificial
  Synthetic
taatgcctttaataatgctgtgcgtacggtcgcgctcgccggagttcgcgccataggtcaccgatacaaacttcggtttcaggctgctaaggcgatcgat

SEQ ID NO: 1275 - DNA, 100 bp, Artificial
  Synthetic
gcggcccgccattaagctgcatgtactggctggcgtagggcatattttgaatatcatcgtccgtcagctgtacgcctggcgtgccgaacagactgtccca

SEQ ID NO: 1276 - DNA, 100 bp, Artificial
  Synthetic
tccagacggagtccgcgaggccaacataaataatgctgccgggcatcggctctacgtgacgcttgttccagtaagccaccggcgctttttgcgtgcgtcc

SEQ ID NO: 1277 - DNA, 100 bp, Artificial
  Synthetic
cacatagacatcgttctgcacatactcgcgcacatgggtacgcacgcgcggtaagtgcgagtcctgcggcggattggtgtagttaaacttgtcgtagttg

SEQ ID NO: 1278 - DNA, 100 bp, Artificial
  Synthetic
tgaagaactttagcgccgaagtaggaaagctccatcgcttcctggtaggacatcgacttcaacaacctcgcatcgggcacctgacgcgggtcgcaggtat

SEQ ID NO: 1279 - DNA, 100 bp, Artificial
  Synthetic
ccatttcgattgccatattgcacagggtcatacgaccttccatgcttaaatcacggattgcttcgccgcaaaactccaccacatgcccggtgccgcctgc

SEQ ID NO: 1280 - DNA, 100 bp, Artificial
  Synthetic
ggcggaaggcaacatccccatcgagccagtgatcattgcgcactcgtcagacagaatgtcgccaaacaggttggagcacagcagaacgtcaaactgtgat

SEQ ID NO: 1281 - DNA, 100 bp, Artificial
  Synthetic
cgctgccaacaatggctttgtttgccgggatcggcatattacaaatctggctaactaactggctggtgcgccatatctcctggtgattaatggcggtgtg

SEQ ID NO: 1282 - DNA, 100 bp, Artificial
  Synthetic
ggagaaccttcctggcagaacggagaatcatcaccgaagaactgctggaaattacgcggcatacgcggcgtattaacggttgtgctaccttctacgttaa

SEQ ID NO: 1283 - DNA, 100 bp, Artificial
  Synthetic
gcgcacttatgtcagcagcgctggcatcgggctgaacgaacaaaaagaccatgccgaaggcaaactgggctttcagtcctggggagaaccgtcgtaaagg

SEQ ID NO: 1284 - DNA, 100 bp, Artificial
  Synthetic
ccgttgagtcaccctcgatagccacgtcaaatagacctttctgtgagttaaaacctttaatgccttcggcatactggaacgccaggctaccgagtggcgt

SEQ ID NO: 1285 - DNA, 100 bp, Artificial
  Synthetic
gctgttgtaataccaataatttgctaaggcttctgactttctggccgcaatcaatacgacctgtttcccctttaccgcggataaccactcattatcacgg

SEQ ID NO: 1286 - DNA, 100 bp, Artificial
  Synthetic
cgccaccactgcaaaaatgaggcagcctactaaaaacgggatcagcccgaaaatggtgccgacacctaaaccaatttccacccgtgggcgacctgtttcc

SEQ ID NO: 1287 - DNA, 100 bp, Artificial
  Synthetic
aaatccggccagggttcattcagttgattcacagcactgtcataatcttccgcttcgaccggctgaaagccattttgttcgagcacgaagcagaccattt

SEQ ID NO: 1288 - DNA, 100 bp, Artificial
  Synthetic
aaaaagttacgccgcgccccttccagttgatgcatttgcgtgacatcacgcgccaccatcagcaactgtttgtgggtataaggcatgacgcgaatttcca

SEQ ID NO: 1289 - DNA, 100 bp, Artificial
  Synthetic
aaacaaagccgacgtgcttcgcgcgcaactttgcccgcgcttcttcgtccatattatgtagcggttgtcccaccagactcacttcgccactgctgccgtc

SEQ ID NO: 1290 - DNA, 100 bp, Artificial
  Synthetic
gctgatcgccaatcttataggtcacatcataaccgagcattttttctgacttgtcatacaccgttttacaacgctgttgcgtagtcgtgtaagtatcgct

SEQ ID NO: 1291 - DNA, 100 bp, Artificial
  Synthetic
ccaaaccatgcgccaaggctgtaataaggcaaattgcggatcacactgttcattccccaccacggcgtgggaacgaaattaaccgccacactcagcagta

SEQ ID NO: 1292 - DNA, 100 bp, Artificial
  Synthetic
gattgctcaatttttaaatcacggctggcaacgctggcattacccattaccgcaacaatttctgcaacctgtgcgctgtcagtttttgccatttcgttgg

SEQ ID NO: 1293 - DNA, 100 bp, Artificial
  Synthetic
accgtcgcggcctttttctgttactgcaccaacaccagcgccaacagctgcacctttcagtacgccattaacaccattgccagtaagtaaaccaacgcct

SEQ ID NO: 1294 - DNA, 100 bp, Artificial
  Synthetic
ccgccacagcacgcaattcatcgctgtccgcttcatgacgcagctgatgatccacattctttacccacacaaattcatgtcctttgtgccctgccatgag

SEQ ID NO: 1295 - DNA, 100 bp, Artificial
  Synthetic
cgccgcgcagcggatagagcagagcaccttaaactgtgccgcggtaatatccagcggagacagatactcgttaagcagacgatctttcttctgattaacc

SEQ ID NO: 1296 - DNA, 100 bp, Artificial
  Synthetic
tgtaaattttgttctgggtttccatgtgcgccagcatgttagctttgcgctgttcttccatttttgcgatctgcgcttcagcttttgctttatcgaaggt

SEQ ID NO: 1297 - DNA, 100 bp, Artificial
  Synthetic
ctttgatattcatttggtcagagatttgaatggttccctgacctgccatccacattcgcaacatactcgattcggttcggctcaatgataacgtcggcat

SEQ ID NO: 1298 - DNA, 100 bp, Artificial
  Synthetic
tcacttcgcaaaccagccatagtccggcaaacatgatggtgatatctgaaaagcgttgcaccatagagattaacgatgcattggttttcgctcgctcgcg

SEQ ID NO: 1299 - DNA, 100 bp, Artificial
  Synthetic
aacaggaacataccgctgttccagtaatattcgccgcttgccacataggcctgggcggtttccagattcggtttttcgacaaactgcgccacttcaaagg

SEQ ID NO: 1300 - DNA, 100 bp, Artificial
  Synthetic
ggcagacgcagccccagttccgccatcgtcagccgctcaaatgcggcttccagcgtttcgtctttctgcacgcgccctcccggcacaaaccagtaaccct

SEQ ID NO: 1301 - DNA, 100 bp, Artificial
  Synthetic
taacgaaatcttccggctgttcctgttgcagcatcatccactgcatttttacgtagtctttggcatggccccagtcacgcagggaatccatattgccgag

SEQ ID NO: 1302 - DNA, 100 bp, Artificial
  Synthetic
tggtgaaatgttgacttgcatggtcgtggctaccggtgcataaataacttttttgcgatatcaccgaatgtgcgccaatggttatttcaccgagggtata

SEQ ID NO: 1303 - DNA, 100 bp, Artificial
  Synthetic
ccctgcgagaatcatagcatcggttttaggcgttttgataccaaactgtttgatgctgagccaaattgagattaatgccagagcgaaaaatgccggttcg

SEQ ID NO: 1304 - DNA, 100 bp, Artificial
  Synthetic
tactccaccaccatccgcaggaagatgtcgtaatcctgtgccgctttcagttcggtatcgaacaaacactctttgaaacgccacgcccaggtaaagacct

SEQ ID NO: 1305 - DNA, 100 bp, Artificial
  Synthetic
agttcagaatcacccctttcaccggaataccgttttgctcaaagcggctcagactggtttccacttctttcaatgtgttgaccgcataacgcgccaccat

SEQ ID NO: 1306 - DNA, 100 bp, Artificial
  Synthetic
attcgttatcccagtgaccaaacagcatcactttgccgcgcatctcaggtgccatctcgcataagcgttcgatatggcgcttttccatggtcaaaatcag

SEQ ID NO: 1307 - DNA, 100 bp, Artificial
  Synthetic
ttaccagttatgaatgtcgctggctgtatccgtcatgtaacggacaccgctaatagttggcagcaactgattgatcagacggttccagcgggaaaccggg

SEQ ID NO: 1308 - DNA, 100 bp, Artificial
  Synthetic
tgcactctgggagtcattgcggccttgccagaaccagaatgcggcgatggcggcgataaccaccacgattacgattacccaacgggatttataactgcct

SEQ ID NO: 1309 - DNA, 100 bp, Artificial
  Synthetic
cgtaatgatcgcgatcgccaatttgtaatttgattgatggcagtagggtgatttcacctgcgtttgctgcaagcggggtaaatgccatcagggcggccgc

SEQ ID NO: 1310 - DNA, 100 bp, Artificial
  Synthetic
tttatcgatggtcacgctggcttctccttttttgcctttcaccgttttacccgcttgtttttcaatggtaatcacttcgtgtccggctttacggaactcg

SEQ ID NO: 1311 - DNA, 100 bp, Artificial
  Synthetic
gtaaatatctcggcaatcatccgttggcgggtaagaatatccggctctttgcgcaccgcatggcaaacacgcaatgcttcgtaagttatttgctgatgaa

SEQ ID NO: 1312 - DNA, 100 bp, Artificial
  Synthetic
tgctgctgggagaatttctccagcgcagtacggcagattttgtccgccacgtcgccaatacgctccagctcggcaatggttttactgatcaccataacca

SEQ ID NO: 1313 - DNA, 100 bp, Artificial
  Synthetic
cccaacatcaatagcacaatcagcgccgccagttttaccagcacgctgaaaattatgtcgccctttttacccggtgggttaaaagcaggcttggttgcag

SEQ ID NO: 1314 - DNA, 100 bp, Artificial
  Synthetic
gaaggttgcacctgcacctgtcaggcttgcttctgcaaacacagagaaagcgctcatcgataaggtcgcggcgacaacagttgcgacggtggtacgcata

SEQ ID NO: 1315 - DNA, 100 bp, Artificial
  Synthetic
atacccacgccaccgccaacgtacagcatcggtttttgcgcttttgccagcatctggcgcgcttgctcaacttcggcatgtgggaaagtcacttcgtttt

SEQ ID NO: 1316 - DNA, 100 bp, Artificial
  Synthetic
cccaatcaggcgtttcgataccatctacggcttttagttccgtacctggtgcaatttgtgcttccgcagctatcgaattggctgctatttcaccaaccac

SEQ ID NO: 1317 - DNA, 100 bp, Artificial
  Synthetic
ttacgttcgcccagagacgcgaacctgcaccgattttgctgtttttacctacgaagcaaccggcaccgataatcacgttatcgcccagttcaacgccgga

SEQ ID NO: 1318 - DNA, 100 bp, Artificial
  Synthetic
cgtcatcgtcacttaacacatcaaaggctttttgctggatttgcgccagtaagtcatagagctgaatcagtcgctgaccatagcgggtcagtactgcgcc

SEQ ID NO: 1319 - DNA, 100 bp, Artificial
  Synthetic
gcaatttcgacgcgctgtttatctttacccagcttcaccaggcgttcggcaacatcaattgctttctgccactcactggtagcctggtagatttgtagca

SEQ ID NO: 1320 - DNA, 100 bp, Artificial
  Synthetic
tccctatttcgcgctcttcacccagcgcctgcaaaatgccaaaaacttttagcacggaagatacagaatcaggctgtttatccagatctgcgttagccat

SEQ ID NO: 1321 - DNA, 100 bp, Artificial
  Synthetic
catgatgaatgttgcgacgcaccgagagcgtcgccgcgcccagagaacaacccagatcgtaaacctgcgtaccaggttgaacgaagcgctcggctaacat

SEQ ID NO: 1322 - DNA, 100 bp, Artificial
  Synthetic
ggtcaagcgcggcgctcacttcatctttgggaccgctcagatcgataaacgctgccgtgtgaccacggaaggtacgaaatttattgcccaggcgtacatc

SEQ ID NO: 1323 - DNA, 100 bp, Artificial
  Synthetic
agggtgattttcgggaagttggcgtaatccagaccggagaaaatttcatcgacatacattttagcgatgcgatgcggcgtttccatcaaactgtcatcag

SEQ ID NO: 1324 - DNA, 100 bp, Artificial
  Synthetic
cattacgtgggttagcaaacactttcccgcccgtgcgtcgcgcatcttcgttaatcttttcgaaccccgcctgcggcaggaacacttcaccacgcacttc

SEQ ID NO: 1325 - DNA, 100 bp, Artificial
  Synthetic
gcgcacagtcaaccaccatgcgaatacgctcttcattaccgatattgccagggttaatacgcagacaatcgacgccgtattccgctactttcagcgcaat

SEQ ID NO: 1326 - DNA, 100 bp, Artificial
  Synthetic
atccgcgcaggaatgttgaagcaagatcggcgggtgccttatcttcttcaatgtcgcgtaccgtggaaaccttcaggcaaagtcgctcggcaacggcctg

SEQ ID NO: 1327 - DNA, 100 bp, Artificial
  Synthetic
ccgctctttgagatagttatcgcttagcgcggcaaactgttcggcaaatttttcaatgaccgtttttaccgcccactctgccaccgagcctttatcaacc

SEQ ID NO: 1328 - DNA, 100 bp, Artificial
  Synthetic
cgccgctcaccagctgcaagagaaaccatttttgtttttggccgatacaaaccggcttcgtgtcccaacgcaccaaacgtttcggtaatttgtagcgcaa

SEQ ID NO: 1329 - DNA, 100 bp, Artificial
  Synthetic
acgacagcacctcttcgcgccgttccagtggatgacaccagaccagcgaacagcgtccgtcagacatcggcaacatcgccagcgggccatgttgcgtaaa

SEQ ID NO: 1330 - DNA, 100 bp, Artificial
  Synthetic
ataagcgtacgccagcgaacattaccgcgtcctttttcaggcaacgagtcatcgtaaatagcccagctattgccgccctgcaatcccgcattacgcgtgg

SEQ ID NO: 1331 - DNA, 100 bp, Artificial
  Synthetic
tcgtgcagcatacgtagcgccaggtcagtaattggcgaaccaatcttccggcctgtatgttcaccgttagcaatgcgaatggctgaacattttagatcct

SEQ ID NO: 1332 - DNA, 100 bp, Artificial
  Synthetic
gccgccagagcaatagcgatagccaccgcgctgagaatcaatgcggtattgttcttactctttttttctgttgcgacaggttgtgacgtggtgtccacgg

SEQ ID NO: 1333 - DNA, 100 bp, Artificial
  Synthetic
tcagtgggtacattggcagcacgcatggcgtaaaggcgataccaataccgatcaacaacgcccagagcgcggaaaagggcaattgcgcggtgggctgctc

SEQ ID NO: 1334 - DNA, 100 bp, Artificial
  Synthetic
aagagtcgacgatcaggtctttcttctctttggtcacaaagcggtcggcctggttgtccatggtctgaatacgtgcgtcgagcattttcaccgtttcaat

SEQ ID NO: 1335 - DNA, 100 bp, Artificial
  Synthetic
cgacaggcaggtgtaatgtggcaaaactcactgctgcaattcaccagcgataagggctccagctcgcgcaccacatcaccaatacgtatcgcactcgccg

SEQ ID NO: 1336 - DNA, 100 bp, Artificial
  Synthetic
ctatacgcagaccgtcgttgatctggaagctgttatccatatgcggatcgttaatcagccctttccagcccaccgtggtacgcggcttttcaaaatagac

SEQ ID NO: 1337 - DNA, 100 bp, Artificial
  Synthetic
acggaacatagttctcactgtagccatgctgttcggtatgcagatccagcataaactgcgacagtgcgcggtgcatgcgagcaatctgccctttcattac

SEQ ID NO: 1338 - DNA, 100 bp, Artificial
  Synthetic
cagcatatttcgccgatgaggtcatgtggcagtcgataaccacaatcagctcgcacttcttatcatcctgaaggatttcatgggtacggttgatttcaga

SEQ ID NO: 1339 - DNA, 100 bp, Artificial
  Synthetic
tagtgtgatagcttttcttcgctactccacggctgcgggcgcgtagttcattgttggtatcaatggaacgataaccggaaatgagttgcaccggtttgcg

SEQ ID NO: 1340 - DNA, 100 bp, Artificial
  Synthetic
ctactttgttgccatctttgttatagatttctgcagcgtttgcagtacctgctactaacagagcagggacgatcactgccagaatattgcgcttcatcat

SEQ ID NO: 1341 - DNA, 100 bp, Artificial
  Synthetic
acccgatgttcttcccacaggccatctgcggcgcgaaaggtacgaatacctgattccgcagaaatccctgcccctgtcagtacgagtactcttggttttt

SEQ ID NO: 1342 - DNA, 100 bp, Artificial
  Synthetic
acgagacggtaaaattctccgggatgtgcattttctggctgttacgggcaaacataatatgctgcaggcgcgcttcgacatccactttggtcaggtaggt

SEQ ID NO: 1343 - DNA, 100 bp, Artificial
  Synthetic
ggtcggaagcgagagtaattaaactgatgtgtccctttactggcctggcgatagataccgcttttgccagcagttgctgactttccggtgtaaccgcaac

SEQ ID NO: 1344 - DNA, 100 bp, Artificial
  Synthetic
cacgggtaggcgaaagtacaggtggcgaggctcgccaacaataccagcccggtgtaaagcatggcgaaaccatcaacgcgcatcagcggcgtaacgtcca

SEQ ID NO: 1345 - DNA, 100 bp, Artificial
  Synthetic
gaacttggttgccgccgtgatacgcgttttaccgtcagaggctttatgcccccacagtgcgatcaggaagtacatcggcaccagcatcatttcccagaag

SEQ ID NO: 1346 - DNA, 100 bp, Artificial
  Synthetic
acgatacgaccacgataacggggcggcagatagaccggctcttccgggtacattcgcgtttcgcgtttggcgaacgcgtgcaggccgatcatccagatac

SEQ ID NO: 1347 - DNA, 100 bp, Artificial
  Synthetic
tcatcgcctgattcagcgccagatctttacgctccagcgagtgcatatagcgcatcatttcggtttcgctgtggtagcgattaaacaccggatgggtgag

SEQ ID NO: 1348 - DNA, 100 bp, Artificial
  Synthetic
ccgccgatgttgatagccagcaggaacatcaggtacatcacaaagaggaaaatcggcagaccgaggaaacggttgagcacgattttatctaccgcagtgg

SEQ ID NO: 1349 - DNA, 100 bp, Artificial
  Synthetic
gtcagcatggagcggaaattcgctttatcctgcactttatctaaccacagacgaatcagcatgcggtcatataacgcttccagactgctgtctgcttccg

SEQ ID NO: 1350 - DNA, 100 bp, Artificial
  Synthetic
aacgtcaggccaagtacgtttttcacatcacggttcagtaaccccgcgcgatccagttcgccgagaataccgataacaccaccagcacggtgaacatctt

SEQ ID NO: 1351 - DNA, 100 bp, Artificial
  Synthetic
agttgttcacaggtcagctccagttcaacgtcggttttaatcgtcgccagctggtatgagagataagcaacttctttgttttgctcgagcttcgctgcca

SEQ ID NO: 1352 - DNA, 100 bp, Artificial
  Synthetic
gcgaaacggcggtcaatttcgtccattcgatcccacgggttatcgatagattttccttcgcctaatagctcctgagcgacagtttccagcgagaatgaag

SEQ ID NO: 1353 - DNA, 100 bp, Artificial
  Synthetic
gataagccggagaggtggtgtaactcagtaccagatcgctttcaccttttaaaaacaggccgtaggcttcgctccagcctttggtgaccgtgaccgtttt

SEQ ID NO: 1354 - DNA, 100 bp, Artificial
  Synthetic
cgggcataatttgagcgccatccctgtcggcatagcgctacgtacgccaaatttacgcgcgggataattggcggtgctgatcaccccccgacgttcgcgg

SEQ ID NO: 1355 - DNA, 100 bp, Artificial
  Synthetic
atacgtcgccagaccgctggcgcgtttggtcataaagttgtcggtctgcgccgaggagtcgccaccaaattccgggaacatatcggtccaggcttccacg

SEQ ID NO: 1356 - DNA, 100 bp, Artificial
  Synthetic
aaaaccgcgtcacgcagctgactggtgatatcgcgcatggttgcttccagcagaccatttttgtccctgaaatagtggctgatgatccccgtagaaacgc

SEQ ID NO: 1357 - DNA, 100 bp, Artificial
  Synthetic
aatccggccagggttcattcagttgattcacagcactgtcataatcttccgcttcgaccggctgaaagccattttgttcgagcacgaagcagaccatttc

SEQ ID NO: 1358 - DNA, 100 bp, Artificial
  Synthetic
taaggatgttctgcccgttatcttccggccagcgcaaaccaagaatttgttgcgccagaccgttacaccagaaaataccgccctcttccgtggtcagcac

SEQ ID NO: 1359 - DNA, 100 bp, Artificial
  Synthetic
gcggcaggtacaaagcgcgtgttgtaccattcgccgttatagcaaacgcggaaatccagcacgtcgatatcttcatagcggtagcgtgggtagacatcga

SEQ ID NO: 1360 - DNA, 100 bp, Artificial
  Synthetic
ttgtggcgggtgacgataccagcgtcgtcaaactggttcagtacgcgatataccgtagccagaccaatttcttcacccatatcgatcagacgtttgtata

SEQ ID NO: 1361 - DNA, 100 bp, Artificial
  Synthetic
tctcgcgtacgtcgatttttttacccagatattccggtgtacgaccaatcatcagcccggcaataaacaccgccagcaggacaaacagcatcatgccgta

SEQ ID NO: 1362 - DNA, 100 bp, Artificial
  Synthetic
aatcaaacagcgtcggcggtggctcacccggtccacgaccggagaggaagcgcgagtagttttcaatccccgaacagtagcccagctcgttcatcatctc

SEQ ID NO: 1363 - DNA, 100 bp, Artificial
  Synthetic
cggtgttaaccagagttgccagcgcgattgctgaccgagttgctgtaacaatggcaacagtagaagttgcgtcatcatgggctgatcttcgcgatagaca

SEQ ID NO: 1364 - DNA, 100 bp, Artificial
  Synthetic
ggaaacgcatactgaatacggcgggaaagttcgccagccagggcgtcaatagccccagctggcaatggagaagttttcgctatggtgacttcaattcgca

SEQ ID NO: 1365 - DNA, 100 bp, Artificial
  Synthetic
gctatcgacaatcagtaaatcaccgtcactaattccaccatcaatcatagaatcaccacttgctttgacgaagtaagtcgcgctgggatgctggatcaac

SEQ ID NO: 1366 - DNA, 100 bp, Artificial
  Synthetic
cagacgtcatccacggggagagcagacattaatttacgctggcgttccagatttgataaatccaccaccccacccgtctgccgctgccatttttttgccg

SEQ ID NO: 1367 - DNA, 100 bp, Artificial
  Synthetic
ggcgcgcatagccaaagtaggggataacagcggtgatacgacctgcggaagcacgacgcagggcatcaaccataacgactaattccatcaggttgtcgtt

SEQ ID NO: 1368 - DNA, 100 bp, Artificial
  Synthetic
aacacgtcaggattgcggaagggacaatatgccaccagtcaccctgtgccagcacgggcgtcagctcggcatttttggcaaataccgcacaagcaataga

SEQ ID NO: 1369 - DNA, 100 bp, Artificial
  Synthetic
cagaatggtgctcagcacatctttttgttctgccagccatagcgaaagggcttcacgttgctcgtcttccatttgcactggagaatttgtcagccaggtg

SEQ ID NO: 1370 - DNA, 100 bp, Artificial
  Synthetic
cagattttttataggctttgttccagtcattgcctagtacgttcatggcgtaaagtacgcgacggtgtaccggcttcaggccatctcggacatctggcag

SEQ ID NO: 1371 - DNA, 100 bp, Artificial
  Synthetic
ctgggaaatcgaaacgttatgcagtccttctgccgcccaatccagaacgcgatggattttgtcgagattgatgcgctctgtgctaccgtcgcgctttgtc

SEQ ID NO: 1372 - DNA, 100 bp, Artificial
  Synthetic
ggtcaacgatcagcgccatacgctcatcgatgttagaaaccagtttctggaagtacggtaccggctccagcgtttcttcattacggtacataccgacaac

SEQ ID NO: 1373 - DNA, 100 bp, Artificial
  Synthetic
aaattacggcaggggccgcaccacggtgcccagaagtcgatcaccacaggtagatcatccttcagcaatttgtcgagcgtttcaccggtcgcattaatca

SEQ ID NO: 1374 - DNA, 100 bp, Artificial
  Synthetic
taatgccaatgcattctggctggtggtcagcaattgaccgctgttcgccagacgtttgtactcttcgtcgatttgttcaaactctccgggctgcggatta

SEQ ID NO: 1375 - DNA, 100 bp, Artificial
  Synthetic
atccgccagattttttatccagcccgacgggctaactttgcgtgccgcgcgcataaacagatcgcggtacataccgtatggccatgcaattaagatgttc

SEQ ID NO: 1376 - DNA, 100 bp, Artificial
  Synthetic
aagacagttggcaaaggttcgccatattttcgcgtcgcctgatcgcgcgccagtgcgcaccagtcgatgtcacattcacgcatcgctttttctgtcgctt

SEQ ID NO: 1377 - DNA, 100 bp, Artificial
  Synthetic
agatggtttccacatccatggaacggtcttcacccaggcgcatgatggagcctttaccaaattgtttctcaatctggcccagtgctgccgccaacgcttt

SEQ ID NO: 1378 - DNA, 100 bp, Artificial
  Synthetic
aaagcaaaccagacggtgccgacaggcttctcttcactgccgccatccggcccggcgataccactaatagacacggcataatcagcacgagccgctttca

SEQ ID NO: 1379 - DNA, 100 bp, Artificial
  Synthetic
ggcgagatggaaagcgtgatccaactgcgcatgttcgatcagcgaaatctctttgttgttctcactggcggcgagcattttttcataacagcgggttatc

SEQ ID NO: 1380 - DNA, 100 bp, Artificial
  Synthetic
gcagaagctttagcgcgcttacgttcggtagtcggtttttcatagaactcacgacgacgaacttccgccagaacacctgctttttcgcaggaacgcttga

SEQ ID NO: 1381 - DNA, 100 bp, Artificial
  Synthetic
ctcccccacaatcaacacgtaggtatcaatacctgtatccctgactgataattgaaaatacggcaccgtgtttgcaattgagagtaatctttgatgctct

SEQ ID NO: 1382 - DNA, 100 bp, Artificial
  Synthetic
agacgcagatgatcgcgcagtttcgccatctccatttcatgagcggtcaccgtgacgttcagttcttcaatggtgatttcctgaaaagccagtcggctct

SEQ ID NO: 1383 - DNA, 100 bp, Artificial
  Synthetic
ggaacaccagcatcaccaggagagcaataagcaactctcgcaccatgattgcccgccgtcttttcggttcagtatgtttcagtacggacatgaaaatagg

SEQ ID NO: 1384 - DNA, 100 bp, Artificial
  Synthetic
ccgtcgatggctgcggcttcgatcaacgaacggggaatggattgcagcgcggcatagaagaacaggaagttgtagctgatttgcttccatactgaggcaa

SEQ ID NO: 1385 - DNA, 100 bp, Artificial
  Synthetic
tgttcgtagttgcctttataggtcggtacaattttgtaatccgggttttcggcgttaaaacgttgggccagagaatccacctctttacccagttcccctt

SEQ ID NO: 1386 - DNA, 100 bp, Artificial
  Synthetic
cgggtctggatagcaaaataagtttgccctgccgcaataaccggtttcgcagggtcgccgttttgtactaccaggtaacaggcatagcgggagagatgaa

SEQ ID NO: 1387 - DNA, 100 bp, Artificial
  Synthetic
ttggcgaagcacagcagccagatcactttgtttttcagcacatactcaacaaagatctgccacttggtcatatcggtagattctgtctctttgtcctctt

SEQ ID NO: 1388 - DNA, 100 bp, Artificial
  Synthetic
agaggcaaaatcatctatcaggtagagacaccgccgcccgctttcacgggtgaggaactctccttgcgccagacgtaaggcgcacatcaacagcttaagc

SEQ ID NO: 1389 - DNA, 100 bp, Artificial
  Synthetic
cggtcagcgacaacgtaccgtcagcaacctgtaacagcagattaccgagaatcggtagcgtaggacgaccacctaacggaccgctcacctgttgtagcgg

SEQ ID NO: 1390 - DNA, 100 bp, Artificial
  Synthetic
gccgcgcgcgccagttggttagatttaccttcaacgaagttatcaaacgtgtgtttgacgtttacgttagaacgataggtcggttctgccggggccggga

SEQ ID NO: 1391 - DNA, 100 bp, Artificial; identical to SEQ ID NO: 1313
  Synthetic

SEQ ID NO: 1392 - DNA, 100 bp, Artificial
  Synthetic
aaggttgcacctgcacctgtcaggcttgcttctgcaaacacagagaaagcgctcatcgataaggtcgcggcgacaacagttgcgacggtggtacgcataa

SEQ ID NO: 1393 - DNA, 100 bp, Artificial
  Synthetic
aatcaacgcgaagatcaatggtccccatccgcgatagccgctggcgtagttcatcttcactgatggtttcgtggcgggttaaggtacttcccacgcacac

SEQ ID NO: 1394 - DNA, 100 bp, Artificial
  Synthetic
agcacgtaatccagagttcgcagccccggcagctgttgataatctttgcgtcccagcaaacggatatggttacgcaccgacgcgatatgttcctgtagcg

SEQ ID NO: 1395 - DNA, 100 bp, Artificial
  Synthetic
ttccagcacgccgatggcctcgccgaggctggcgacggtcgcagtgtcgagtttattaactgaacctggggcatcaaataccagttcggcaatgccatct

SEQ ID NO: 1396 - DNA, 100 bp, Artificial
  Synthetic
aaccccaaacgctgcgcgatttccgcacgcgtcggcggcatacctgtctggctgatgtgatcacggatgagatcaaacacctcttgttgcctggccgtta

SEQ ID NO: 1397 - DNA, 100 bp, Artificial
  Synthetic
atatgcagccccatcaccagccagacatccagcacaatgttgaggatattgccgaccactaacaaaattactggcgcacgggcatattgcacgccgagta

SEQ ID NO: 1398 - DNA, 100 bp, Artificial
  Synthetic
caacgtaacggcgctgcccttcggcatataaggtgtcgaaagcgagcgaggatttgccagaacccgaaagcccggtcacgacaatgagcttgtcgcgggg

SEQ ID NO: 1399 - DNA, 100 bp, Artificial
  Synthetic
accgacgaaaacggatgttgagtgtgctggccagaaacatcattacggcactaagaagttgccagcgaagaagaaccacgccagtggtgagggtagccat

SEQ ID NO: 1400 - DNA, 100 bp, Artificial
  Synthetic
cgcgggagaaggtctgctgcgagacataacccaggtccattgcgatatcaaaaatcggacgctcggtggtgcgcaactcaacggcggccagtaacaggcg

SEQ ID NO: 1401 - DNA, 100 bp, Artificial
  Synthetic
  misc_feature (1)..(11): n is a, c, g, or t
nnnnnnnnnnngaggtggagttaggatcgccattgccgaaggtgagatctttccgcttcgccagcagatcgttcaggttgttgatcggactatctttgtt

SEQ ID NO: 1402 - DNA, 100 bp, Artificial
  Synthetic
ggctgctgccgtcgtagaagacgtgcccctggcgcagggcgacgatgcgttcgcagtagcgcagggcgtaatccacctgatgcagcgtgacgaccacggt

SEQ ID NO: 1403 - DNA, 100 bp, Artificial
  Synthetic
cgccgcgggtggatttagccgctgcagagccggtcagaacgatgccgccagcagatttagtttcaacttctttacgcttgacgatcacgcgatcatgcaa

SEQ ID NO: 1404 - DNA, 100 bp, Artificial
  Synthetic
acggtcgaactgcataccttcaaccacgtccagttcgtcctgcagaccggtaccgtcttcaacggtgataacgccttctttaccgactttgtccatcgct

SEQ ID NO: 1405 - DNA, 100 bp, Artificial
  Synthetic
cacaatgttgctgaatcatctcgcccagctttttgagtcggttgcgcagaagtttgtgatagtcacggcccagcgcataacggctaacatagccgagttt

SEQ ID NO: 1406 - DNA, 100 bp, Artificial
  Synthetic
ccaccggagccatcaccagcataaagcgaatcagcagcatactgacgcggctgatcccttgctgaaaggcattcggctcgctttcctgctcactaacacg

SEQ ID NO: 1407 - DNA, 100 bp, Artificial
  Synthetic
tgggcatttgcgccaccaccccaatggaacccacaatagcaaacggtgcggaaacaattttgtccgccacacaggccatcatgtaaccgccgctggcagc

SEQ ID NO: 1408 - DNA, 100 bp, Artificial
  Synthetic
tggcagaaacgcatgttcggtacgtgcggaccgcggcacatatcgacatattcttcatggaagtacagacctggcttgtcatcatgggcgatgttttcgt

SEQ ID NO: 1409 - DNA, 100 bp, Artificial
  Synthetic
gcccttggtgatcatcagcataatctgcaattcacgttcagacaaactggcaaatgggctttctgttttttctggttcgatctggcttaacgccatttgt

SEQ ID NO: 1410 - DNA, 100 bp, Artificial
  Synthetic
acgtaatgaatgataatgcccttttgcgcgtcggtgactaccggcacggtgatttccggttttttgctctctttgttcggcacgcgaccaaaggtgtccg

SEQ ID NO: 1411 - DNA, 100 bp, Artificial; identical to SEQ ID NO: 1328
  Synthetic

SEQ ID NO: 1412 - DNA, 100 bp, Artificial
  Synthetic
agatcttgcaaccgttggttcagatcgtccgctgcctgattcaacgcatccctttggtcaggcgggcagttcacacgcagtgaacggccaaaaatttgga

SEQ ID NO: 1413 - DNA, 100 bp, Artificial
  Synthetic
tatgcagactgatgccgagagtgagcagaatggctgtgcgcttgatcgattttggcaacggctgcaccgatttttgcattaaatcctgcggatgcgcatg

SEQ ID NO: 1414 - DNA, 100 bp, Artificial
  Synthetic
aacgctatcgacgttaacacccgcctgttcaagtacgccgcggaccttatcgagatacagaggagccagggtttcgttggtgaccaacatgacctgctcg

SEQ ID NO: 1415 - DNA, 100 bp, Artificial
  Synthetic
  misc_feature (13)..(15): n is a, c, g, or t
attgtcggcatannnaagatggtcgccggagaagaaggtgacaccgccaaaattgacgcggacatcgctttcgccaatgccttcgccagcggcaccaacc

SEQ ID NO: 1416 - DNA, 100 bp, Artificial
  Synthetic
ttgttaatgcgtaccatcagatcggcagcaatattattgaccgtcggcgttaaccaggccggacgcaccgcttcgatgggatcgatagattcacgccagt

SEQ ID NO: 1417 - DNA, 100 bp, Artificial
  Synthetic
ggtccatttacgggtacgcagctgaccttcgatataaacctgagaacctttacgcagatattcgctggccacttctgccagtttgccgaacagcacaacg

SEQ ID NO: 1418 - DNA, 100 bp, Artificial
  Synthetic
cgttaccgtattactgctgataacacccgtagtgcggttactttccgttttaaacggattgcgcgccggttcgctgacgcgcggtgcgacaaccgcaggc

SEQ ID NO: 1419 - DNA, 100 bp, Artificial
  Synthetic
gcggctgaacttcgttggtatacgcttctgcttcacgaatgtattgctgttcgttttcacgcgcggcaatcgcatcgtcaaacgccgcttttacttcttc

SEQ ID NO: 1420 - DNA, 100 bp, Artificial; identical to SEQ ID NO: 1334
  Synthetic

SEQ ID NO: 1421 - DNA, 100 bp, Artificial
  Synthetic
gatccttcaaaggtcacatgcccaaagcggtaacgttcgccactgttataatcaatatcccagaaggctttatgcaggccgagcgcaatgcccagctgcg

SEQ ID NO: 1422 - DNA, 100 bp, Artificial
  Synthetic
tcttctggatcggtcacttcgtaaccgagtttaaacgcttcaactgctgctttttccagggtttccagatcgtctgcggaaagatggtgttcgatggtgt

SEQ ID NO: 1423 - DNA, 100 bp, Artificial
  Synthetic
ccggtggtattttctgtcgggatcactttccccagcaggccgttaccaacggtgcccattaccgcgctggtttcgccaagcagttggctccactgcgcca

SEQ ID NO: 1424 - DNA, 100 bp, Artificial
  Synthetic
taatcgtattccggcgttaagcgcaacagcgtcatcggtacaccgatgtcgttgttgagattgcctgccgtataaagcgtgttgccgcactggcttaaaa

SEQ ID NO: 1425 - DNA, 100 bp, Artificial
  Synthetic
catgcggaaaatacgttgtccgcgcagtttaaaggagccgacctgcaggatgacagaaagcgtttctaccacgaacacgccccccataatcaccagcagg

SEQ ID NO: 1426 - DNA, 100 bp, Artificial
  Synthetic
aaccacagcagcataaagccagcaatacccagcaaggtggcgtacaccagcgagacagcaggagagatcaggcctttaaccagcacccgattcttcgtcc

SEQ ID NO: 1427 - DNA, 100 bp, Artificial
  Synthetic
aacctgtaccactgccattgccaggattgttcccagaattacggccggagaggcagcccctgtcatcaccatccagaacggaatcaccgtcagaatgatc

SEQ ID NO: 1428 - DNA, 100 bp, Artificial
  Synthetic
tagccgccatgccgtaggtgatggagctgaacaacagcaagaaagtttcaaccagaacgaacggcagttcgaaaatgtccttacctgtcgggccgcctgc

SEQ ID NO: 1429 - DNA, 100 bp, Artificial
  Synthetic
aaactccagaataccggcgcaacctgaggtatcgcgccacgcatcgccgcctggtactgtgcggctgtgacatgattcatatccggcgcatagcgggaga

SEQ ID NO: 1430 - DNA, 100 bp, Artificial
  Synthetic
ggcggaacgaagctaccaatgaagatgccccagtcccacatgttacgccagcgggtttcttcaatcttggagcggtagtcaaaaccgaccggacggaaga

SEQ ID NO: 1431 - DNA, 100 bp, Artificial
  Synthetic
ccgtgaatcacaccagcacagacggcccacatcagcaataaaccatgccagatttccagttcactggtcttcgcggcaaaacgagatgggtcccaaaaca

SEQ ID NO: 1432 - DNA, 100 bp, Artificial
  Synthetic
tacagcaactcgccttcgttcatcagtaacacgtcacggcactgctcggcttcgtcgagatacgaggtactccagaggattaacatcccttcgcccgcca

SEQ ID NO: 1433 - DNA, 100 bp, Artificial
  Synthetic
cggtggcttttactgattcccacgttgcacgcaggccagcaaaaacacggttcacgtcttcgttacagataggcatgatcaacgccgtgcgatgctccgg

SEQ ID NO: 1434 - DNA, 100 bp, Artificial
  Synthetic
ccagccaccgcccggcagccaatgcaaaatgatcgcaaatatcatgactaataatggcgcaaccacaaaactggggataacaaccccggtcattgccagc

SEQ ID NO: 1435 - DNA, 100 bp, Artificial
  Synthetic
tagccgcgttgagctcggcaaataccgccagtacacagtccgggccaaattctttggatgaaagaccatagcgcccaccaatgacacggggcagagtttc

SEQ ID NO: 1436 - DNA, 100 bp, Artificial
  Synthetic
gccaatatccagaccgtaaacttcataatgatcttcgcgcagcaggcgttctgtcagatggttgccaataaagccattcaccccgaggatgagtacccgg

SEQ ID NO: 1437 - DNA, 100 bp, Artificial; identical to SEQ ID NO: 1344
  Synthetic

SEQ ID NO: 1438 - DNA, 100 bp, Artificial; identical to SEQ ID NO: 1345
  Synthetic

SEQ ID NO: 1439 - DNA, 100 bp, Artificial
  Synthetic
tcaagtggaaaatcgccgcatcccatgcctgcacgccaagcgcgaggaacatgtagccaatctggctcatggtagagtaagcgagaacacgtttgatgtc

SEQ ID NO: 1440 - DNA, 100 bp, Artificial
  Synthetic
cgatgttcaggttctggcgacgacggtgaagttgcagcagcagcgcaaggccgatactcgcttctgccgccgcgaggctgatggcgagaatgtacatcac

SEQ ID NO: 1441 - DNA, 100 bp, Artificial
  Synthetic
taaggcccgaacagcgtaatacccactgctttagcactgattggcgtaccgtcgataccctgatcgttaacaccgaggatggcgtaaacaatcaccacca

SEQ ID NO: 1442 - DNA, 100 bp, Artificial; identical to SEQ ID NO: 1346
  Synthetic

SEQ ID NO: 1443 - DNA, 100 bp, Artificial
  Synthetic
cggttttcagcgcgaaccagatgaatggcggtaacaacgggccttgccagccaccgaagaacagcgtcaccatcaatgcagagatggtcacaatcccgat

SEQ ID NO: 1444 - DNA, 100 bp, Artificial
  Synthetic
tcgcttcttcgtcgtcaatggaaataaaggtgccatcggaagccggtgtcatacaggacatcaccaggcgaccacgcgtgtcttccgcgttttggtattg

SEQ ID NO: 1445 - DNA, 100 bp, Artificial
  Synthetic
agaagcccatcagcttggtgccagcatctttacttttcgagatgttctgataccactccacgccgttagcgaggatcgccggaacgttacacagggtttc

SEQ ID NO: 1446 - DNA, 100 bp, Artificial
  Synthetic
tgaacgattttcagcgcttcaatggacgccgcacgcgggtcttcgtagtggtgcatctcgtgctcaatcgcttcacgctctgccgcactcagctcaaaag

SEQ ID NO: 1447 - DNA, 100 bp, Artificial
  Synthetic
ggaaaaatccgcggcaggtaacccttcgcggtgtgtgcgcagacgttcgtccatgccgtgtaagtcaaacagcatgacgtaaggtttcggcagtttcttt

SEQ ID NO: 1448 - DNA, 100 bp, Artificial
  Synthetic
cgacacaagaaaatgcgccaattttgagccagaccccagttacgcgttttgcgccgtgttttgcggcctgctgttcgatcaattccagtgcccgttggca

SEQ ID NO: 1449 - DNA, 100 bp, Artificial
  Synthetic
ccgccggggcaaatggcgcgctacgaaacgcggaatgagggttatgttcatcaccctcgatatacaggttgccttcaccgcaaccgcatgttgtacacat

SEQ ID NO: 1450 - DNA, 100 bp, Artificial
  Synthetic
acacagaacacatcggcaatcgcctgttgcgccagcaggttaccggcatccggtaccacccgacgatactgattctctaccttgctgtgggccgctattt

SEQ ID NO: 1451 - DNA, 100 bp, Artificial
  Synthetic
cagattttctacgccaactttacccgctgtgtagttagatttggttgcggagtcaccaccaccggcaatggtcccgccggttgctaaaatggtgatattg

SEQ ID NO: 1452 - DNA, 100 bp, Artificial
  Synthetic
  misc_feature (1)..(18): n is a, c, g, or t
nnnnnnnnnnnnnnnnnnttcggaacgcgcaccggtagaaagatcgtccagtttcggcaggtcgagattttcataaggcacacccgtcagtaccagaacc

SEQ ID NO: 1453 - DNA, 100 bp, Artificial
  Synthetic
accgcctcagaagacataccgcttatctcattaaccatatttttcatttcacgggtaatggattcggaacgggagagtaacaattgaccggcaggtgtta

SEQ ID NO: 1454 - DNA, 100 bp, Artificial
  Synthetic
cggtattgttatctgcgagaatcggttcaagttgtccgctcagcgtcatgcgttcctgaacttcactcaacagttgttcgcgttcttcttctaatagctg

SEQ ID NO: 1455 - DNA, 100 bp, Artificial
  Synthetic
gctttatcgctgctgacggacgagaaatcagaggcaaacagtgcgctggccatatcttccagctcctgagtcgatgccttctccagattctcaatcactg

SEQ ID NO: 1456 - DNA, 100 bp, Artificial
  Synthetic
ccgctcaccagcagcagaaccaggaaaataatcgccgcccagaaaacgcatttctgaccgaagttataacgcccggtgtcacctacttcctcgttgacga

SEQ ID NO: 1457 - DNA, 100 bp, Artificial
  Synthetic
gcgatacggaaaccggtcgggtaggcgtcgttagtggactgacatttgttaacatggtcgttcgggttcaggtactgatattcacctttctggtgaccca

SEQ ID NO: 1458 - DNA, 100 bp, Artificial
  Synthetic
gctgccgccagagtgatcaggttaatgatcacgataaccgggttttgtaaaaagtcgacgaatcccgcccaggcttccgggccatttttcagggcaaaca

SEQ ID NO: 1459 - DNA, 100 bp, Artificial
  Synthetic
tcataccgtcggtgtaatcacgcaggaaggttttacatgccagttttggcacgttgttaaccatcatgccgcaggaaccacaaatcgccatacggcagga

SEQ ID NO: 1460 - DNA, 100 bp, Artificial
  Synthetic
gtcggacgtaccggaatcggttctttaaccggatcgacgccaacgtacgctttcgccagttcgcagatgaacggcagacgttcatgcagttttttctcgc

SEQ ID NO: 1461 - DNA, 100 bp, Artificial
  Synthetic
gacccatgcgtcgccgttatcagcagcaataattttgaacggcatgatggaaacatcacgctgtacttcttcgtcctggaagcggcggccaatcaggcgt

SEQ ID NO: 1462 - DNA, 100 bp, Artificial
  Synthetic
acgtacagcttcttcgagggtgagctccatgttatagcgtaaatcagcaccgcgcgccgcacgttgacgaccacgtccgccgccaaaaatatcgccgaaa

SEQ ID NO: 1463 - DNA, 100 bp, Artificial
  Synthetic
cagccgcgacgccaagagaggccatcgataagtcattagtgtagaacaatgcgatgataatgatggccccaagatcgtcgataatagccagagccatcaa

SEQ ID NO: 1464 - DNA, 100 bp, Artificial
  Synthetic
cagctcaccgcgtttcacctggccgtattccaccatctgcgaggtcaggtttttcaccatgttgctcgggatagcaaaaccgataccgatgttgccgccg

SEQ ID NO: 1465 - DNA, 100 bp, Artificial
  Synthetic
atgttgttgttgacgttgaaacgacgcgcggtttcagaaagcagtggggcatcgaccgattgaccggtaaactccagacgcagcatcggcacgcagtcag

SEQ ID NO: 1466 - DNA, 100 bp, Artificial; identical to SEQ ID NO: 1356
  Synthetic

SEQ ID NO: 1467 - DNA, 100 bp, Artificial
  Synthetic
ggcggtgatctgcggctgagtaaaataccgccagttcattatctgataattcgtatttatttttctcgataacacgctccagcgtgtcaattgtctggca

SEQ ID NO: 1468 - DNA, 100 bp, Artificial
  Synthetic
ggtagttgcctttgctgcttggttttaccgttggggtgtagtcacctggcgcatggcgctgtaccacttcaaccacctgatcaaccagctcaggtaacgc

SEQ ID NO: 1469 - DNA, 100 bp, Artificial
  Synthetic
ggtgaaaatcaccgtaccgtgatcgcttgggaatgagtcatccgccgcatgatgcaggaagttatagccgatattttcgacaaagggtcggtcgtgcgga

SEQ ID NO: 1470 - DNA, 100 bp, Artificial
  Synthetic
tcatcccgcagacgaatacagccagaacttacccgcatgccaatgccgaaatcggcgttcgtaccgtgaagcaaataaacgccgccataggccgccagac

SEQ ID NO: 1471 - DNA, 100 bp, Artificial
  Synthetic
cagctgacgacgcacatcgcgcgacgagtttgccgcctgatggcgtaacatcaatgcctgctggcgagcgcgtgtttcgctcaatttgttttccagctcg

SEQ ID NO: 1472 - DNA, 100 bp, Artificial
  Synthetic
aatacgttcgcgcatccgttttgcttcatcagccagttgcgctaatcgctgctgctcactttgcgacaattcactgcgaccagaacgattgctgtaatgc

SEQ ID NO: 1473 - DNA, 100 bp, Artificial
  Synthetic
gcgcaaatgacaaaatgatgtaagcaaccagggtaaacagcgccagaccgaagaaaatcgacagcaccaccaggatacgcaccagttttaccggtacatc

SEQ ID NO: 1474 - DNA, 100 bp, Artificial; identical to SEQ ID NO: 1294
  Synthetic

SEQ ID NO: 1475 - DNA, 100 bp, Artificial
  Synthetic
ccggagtaatacacgccgcgcagcggatagagcagagcaccttaaactgtgccgcggtaatatccagcggagacagatactcgttaagcagacgatcttt

SEQ ID NO: 1476 - DNA, 100 bp, Artificial
  Synthetic
tttgcgcgatttccgtcatcttacggctgcggatgtattggcctaatgaatgaccggtttcttttttaaacatccgttgcaggtgccatttggagtaacc

SEQ ID NO: 1477 - DNA, 100 bp, Artificial
  Synthetic
gtggcggcaataccaaacccgccccacaatgcataagcgacagacaagtcgatccctttaacggcctgagaaagcgcactaaaggcagccagcaccgccg

SEQ ID NO: 1478 - DNA, 100 bp, Artificial; identical to SEQ ID NO: 1368
  Synthetic

SEQ ID NO: 1479 - DNA, 100 bp, Artificial
  Synthetic
gaacagcaaggccatgatcatcagcccctgaacgctgctcgactgtatccctgtcaggctcagtaccagcccgaaaacgaccattacggccaggttcgtt

SEQ ID NO: 1480 - DNA, 100 bp, Artificial
  Synthetic
ccaccggttaagccaaatagcaaaatttgccagttggtgacctctctaccatcaaagcgtcgtttaatgtcattggcatgggctcgtgcatgggcatcct

SEQ ID NO: 1481 - DNA, 100 bp, Artificial
  Synthetic
gccaaggataaaagcacgggccgcaggcaaacttaactgccaaccgggcgggcaaggtgcgttatcattttgttttaattttgccagttcatcggcgtat

SEQ ID NO: 1482 - DNA, 100 bp, Artificial
  Synthetic
ttcgatgtcgcttaacgcctggcttagtttatacatcaccgaccatgcattatcaccatccgggctaagcaatttaagcgccaccaggctgttgtcaccg

SEQ ID NO: 1483 - DNA, 100 bp, Artificial
  Synthetic
gctgtagccatcatcgccagattgacaaaaccggcaatcgtcatggcgatagccacatcccatttggtggcggaataacgttgttgacgcgaaccgccat

SEQ ID NO: 1484 - DNA, 100 bp, Artificial
  Synthetic
acttcgccaacggcgatgctgctggcatctttgcctaacagataaccaccgcctggtccacgtacgctggaaaccagaccatttttacgcagacgggaaa

SEQ ID NO: 1485 - DNA, 100 bp, Artificial; identical to SEQ ID NO: 1373
  Synthetic

SEQ ID NO: 1486 - DNA, 100 bp, Artificial
  Synthetic
tggctgtcgataagcccttcgtcccgcatacgagcgagatgctgtgatgtcgcagaggcactcagtccggtaatgcgcgtcagctctcccgcgctggtgc

SEQ ID NO: 1487 - DNA, 100 bp, Artificial; identical to SEQ ID NO: 1379
  Synthetic

SEQ ID NO: 1488 - DNA, 100 bp, Artificial
  Synthetic
aacacgattgtcggaggttccatcacctccagcacctgcttcattgcgattggcaacgccccccagcaaattgctgtggtgagcgccaaaagaatgccaa

SEQ ID NO: 1489 - DNA, 100 bp, Artificial
  Synthetic
cgccatcttgcaataatagcagttcgtctccttcactgagcagacgcagcagcgcagcaaaatccgtcagccagggtgaacgatgtaatgtgtgcagcat

SEQ ID NO: 1490 - DNA, 100 bp, Artificial
  Synthetic
ccagttgctcactccagtaatcaagacagtaccagtttagcgtatgctgtacgtcgtgatattgctggcgcatatattccatcgcttcctgtggcgtaac

SEQ ID NO: 1491 - DNA, 100 bp, Artificial
  Synthetic
aggctgcctcgctggcggggcgacgctgttcagtaatcgcctttacaatcaccgtgcgttcgtcatttccctggcgcagagtgagcgtggcattcagctc

SEQ ID NO: 1492 - DNA, 100 bp, Artificial
  Synthetic
ctacgtcgccggtgcgaataaacaggcgcgtcggcagctgttcagaacgcataaagtaatcttccaggcaggccgccagggtatcaccttccagaccaac

SEQ ID NO: 1493 - DNA, 100 bp, Artificial
  Synthetic
ccgcctgtggcaggccatagcccgcataattacgagcaatatgaacaacaaaccgcaggtgagacaggatcagcgttttagctgcttccagatcgccatg

SEQ ID NO: 1494 - DNA, 100 bp, Artificial
  Synthetic
tgaatgataatccagccctcaggcagctccagcagcagatatttagcccgccgctgcacgctaagcactggttggtcgcttaaacggtagatctcttctg

SEQ ID NO: 1495 - DNA, 100 bp, Artificial
  Synthetic
cttccagttgaatctctaaatcttcctgacggaaacctgccagcgcaagggtaatgcggtagtggttatcgtcgcttttctcaatgttgtacggcgggaa

SEQ ID NO: 1496 - DNA, 100 bp, Artificial
  Synthetic
gcggtaatttccagttcgctctcagcaaaaccagccacagcgatagcaatgcggtaatggttttcgtctaccagttcaacgttatacggagggtagccgc

SEQ ID NO: 1497 - DNA, 100 bp, Artificial
  Synthetic
gggtagtctttggcgctctttaatataatgccgataaagcagcctacgtcataaccgagctgcttcgggctgacatcaatacgcgccccggtaatgatcc

SEQ ID NO: 1498 - DNA, 100 bp, Artificial; identical to SEQ ID NO: 1393
  Synthetic

SEQ ID NO: 1499 - DNA, 100 bp, Artificial
  Synthetic
tggctcttacgcacaaatagccggaagccaaggcgttgttccagatcgctaaactggtgagacagggcggattgcgtctgatgcaacgtcgccgcagcgg

SEQ ID NO: 1500 - DNA, 100 bp, Artificial
  Synthetic
caacggcggctttgaccagatggccctgatgcatttccagtttacgttcaaacagttcgaacagcgtaaaagcatccgcagtaccgcccgcaaagcccgc

SEQ ID NO: 1501 - DNA, 100 bp, Artificial
  Synthetic
ttaataatgctgtgcgtacggtcgcgctcgccggagttcgcgccataggtcaccgatacaaacttcggtttcaggctgctaaggcgatcgatggagttcc

SEQ ID NO: 1502 - DNA, 100 bp, Artificial; identical to SEQ ID NO: 1399
  Synthetic

SEQ ID NO: 1503 - DNA, 100 bp, Artificial; identical to SEQ ID NO: 1400
  Synthetic

SEQ ID NO: 1504 - DNA, 100 bp, Artificial; identical to SEQ ID NO: 1406
  Synthetic

SEQ ID NO: 1505 - DNA, 100 bp, Artificial
  Synthetic
tgatagccagttcccccagcgtgttgccgaagcccgctttcatggtgtgcagcagcgacatcaaatccatgcccgccagcatcccgacggacagcgccgc

SEQ ID NO: 1506 - DNA, 100 bp, Artificial
  Synthetic
acatatcaacgtcaccgttcaggtgcgccgcttcgtggaaggttttcgggttatcttcacgcatggtggagcgcagatgggtgaagtaaatacgcggacc

SEQ ID NO: 1507 - DNA, 100 bp, Artificial
  Synthetic
aacattaacaggaggctgttcgtgccgggcctgttgcataagatctcgcatctgctgacgctgatgttcggttaaacttatgccgtcgaacatatggctc

SEQ ID NO: 1508 - DNA, 100 bp, Artificial
  Synthetic
ccccttcttatttttctctacgcgctgtcggaataagggatcatgtagtaatgcttctatcgcattatcctttatctgccctttagtatgctgatatcgg

SEQ ID NO: 1509 - DNA, 100 bp, Artificial
  Synthetic
aggtaagttactaattggcaaggcatagctgcgccctgtttcatcaaggaagtaaactcgctgattggttttcccgacagcatgacttaaatattggtcc

SEQ ID NO: 1510 - DNA, 100 bp, Artificial
  Synthetic
cgctataaaacgctcttttacccctaagtcatagcgctgtttccagagtgggtcgacactatcggcccaatattcttgcgaagggttatagtgcaaaatc

SEQ ID NO: 1511 - DNA, 100 bp, Artificial
  Synthetic
gtttaccacggtatgcagcaacttcacctttaggatcaagggtaaaaacaacaccttcgctagcatcaagttgtaaacgtaatggatctgccttattcgt

SEQ ID NO: 1512 - DNA, 100 bp, Artificial
  Synthetic
tgttctaggcgctctacaatcttctcactttgagcttcatgtaaatgcaactgaatcttcggtaattgttgatgcacttcatcaagtaaccgtgtcagga

SEQ ID NO: 1513 - DNA, 100 bp, Artificial
  Synthetic
gtttcactgactggtttaagcttgcattttgctgtttcaaataagtactactttcaacaactttagctagatcaattaccccataaccagctgcattagc

SEQ ID NO: 1514 - DNA, 100 bp, Artificial
  Synthetic
tgtttcaatcaatgcttgtgctgattttaaaagtggagccaagcccagttgaacagtcgttgggtaacaacccggattaccaatgacttgagcttgctta

SEQ ID NO: 1515 - DNA, 100 bp, Artificial
  Synthetic
cctgctaaaccaggaggtaaacccataccagagttagctttttgcattttttcttcagaaactacttcagcttgacgcacagcatcattcaccgcagctg

SEQ ID NO: 1516 - DNA, 100 bp, Artificial
  Synthetic
cctgacgagcaatccataaatttgaccccggttctaagttgtcatgttcacttaatgctgcttttcgctggctttccgcagccacttcattaacatctac

SEQ ID NO: 1517 - DNA, 100 bp, Artificial
  Synthetic
ttggtttgaccagagaactgtggttcttggaacttaagcgataaaatatagttcacgccatcccaaacatcttcagccgaaagtttaagattacgtggta

SEQ ID NO: 1518 - DNA, 100 bp, Artificial
  Synthetic
cacacttggattggtcgcatagcgattggcaatcagagctaaagagaccgtattggcaggttcaagctcagataagctgtctgcaacgagttgactggtc

SEQ ID NO: 1519 - DNA, 100 bp, Artificial
  Synthetic
ctgtcatcagctgcaacaaccatagcatctacaaggtcaattgctttttcatcaccgcggaatttaaccttacctgcttccattggtccgccagacacaa

SEQ ID NO: 1520 - DNA, 100 bp, Artificial
  Synthetic
agtaaacgtggtgagggtccataccaaatacgttagcacccacaaatgcagcaacttgaggaatccagtcaactgggatcaagtccattaagttcatgag

SEQ ID NO: 1521 - DNA, 100 bp, Artificial
  Synthetic
accaacaccgatcataggcacagcatcaagaagacccgcgattaagaacatacgagtttgaagttgtggagctaattctggttgacgagcaacagcttct

SEQ ID NO: 1522 - DNA, 100 bp, Artificial
  Synthetic
acagcttctttagcctgttgacgaatacgctcaccttcagccgcagcttgagtacgagcttcttcgatcaattgcgctgcacgacggttcgcttgttcga

SEQ ID NO: 1523 - DNA, 100 bp, Artificial
  Synthetic
cttgttaagcgcagaatcatctatcacttgatcgcctgcacgaattacaacacctgcaataagctcaggtttaacttcaactgaaacagttactgtgctg

SEQ ID NO: 1524 - DNA, 100 bp, Artificial
  Synthetic
cgctgaccacgacccacaggaatcatggtatcaactgatttataaccagtttgaacaggttggtctacagattgacgccaaattacacctggtgctactt

SEQ ID NO: 1525 - DNA, 100 bp, Artificial
  Synthetic
tgagtaatcgcggcttgacgcagcttgttatagatgagttgtaagtctttgataagctgacctgcgttatctgtcgctgctttcattgcgaccatacgtg

SEQ ID NO: 1526 - DNA, 100 bp, Artificial
  Synthetic
ttgcgtctaagtgagcaaatgtagttgcaggcgatgggtctgttaagtcatcggcaggtacatatactgcttggatcgaagtgatcgaaccagatttagt

SEQ ID NO: 1527 - DNA, 100 bp, Artificial
  Synthetic
agcaattgttcagcatttttacgtgcttctaaaattgcagcttcatccaaattgtcagcacggattgcagtatctgcaagaaccgtcacaacatgaggtt

SEQ ID NO: 1528 - DNA, 100 bp, Artificial
  Synthetic
ttcccatttactgattacaagtacagcaagcgcgttacctacaacgttcaacgcagtacgagccatatccatgatacggtcaacaccagcaataaatgct

SEQ ID NO: 1529 - DNA, 100 bp, Artificial
  Synthetic
ccagttctttcctttcttcttttctttttctctaataatccccatcatattttcttttactgcccccacataatcggcatcatcatgttgaatatggtta

SEQ ID NO: 1530 - DNA, 100 bp, Artificial
  Synthetic
ataaatgaagcctccggaaatacccaccatcaccagcataagctggctatgattgtagtgtccgtttgcatctaacatgagggaaggatgcaccagtaaa

SEQ ID NO: 1531 - DNA, 100 bp, Artificial
  Synthetic
ctgcacctacagggttttgcatccagccattcgcaactaaaatccagagcgctgacatgttagaacctagggcaactaaccaagttactcctagatgttg

SEQ ID NO: 1532 - DNA, 100 bp, Artificial
  Synthetic
tgtcaaggttgttgtgatagaaagcagataatgcgcctactacaccaaccatgattgccatagggtgagcatcacgacggaaaccattgaagaaacggct

SEQ ID NO: 1533 - DNA, 100 bp, Artificial
  Synthetic
gtttgcaccttcttcaacaccatgagttacagcagtacgtccatcaaatacgaaacattcaccttcccaaaggctttcatcaggaggagtttcttctaaa

SEQ ID NO: 1534 - DNA, 100 bp, Artificial
  Synthetic
gcgcggcactggttaagtaactgatgacatactgaacgaatcattgcagttgtgattggtacttctttaccttggtcattcaacatatagcagctattga

SEQ ID NO: 1535 - DNA, 100 bp, Artificial
  Synthetic
cgttgttgttcatataatcttttacgctcttcccaacgtttgcgttcccactcactatatcgacgtccatcgttacggtcataacgatcgtcatcatgat

SEQ ID NO: 1536 - DNA, 100 bp, Artificial
  Synthetic
aaatttatgcccacgatcattccattcaccacgaggtccgcctttaggacctttcgggccatgtcctcggtcaaaaggaggatcagcaaagcttgccata

SEQ ID NO: 1537 - DNA, 100 bp, Artificial
  Synthetic
agaccacgttgaatatcaccttcggcatctgccaaagttttaccttgttcagccgtcaatacttgtgcgatttctttcatgttggcacggatcaagtctt

SEQ ID NO: 1538 - DNA, 100 bp, Artificial
  Synthetic
ttaattacacctgccaatgcttgtgggtcgatgcctagcttcacaccgagtgccatgccttcggccaccgcagccattgaaattcctaaaatcaggttat

SEQ ID NO: 1539 - DNA, 100 bp, Artificial
  Synthetic
caacacgatagcccggacttggaaaacctgctgaaccagcatgaatttcatgttttaaaccatgatgattacacaccaccatgcctacttcagtttgccc

SEQ ID NO: 1540 - DNA, 100 bp, Artificial
  Synthetic
gaagcgtttgttaaagcttgcaacacgcccttcattacttgcttgacgtacttcacctgtgtagaacgggtgtgatgcacttgaaatatcaagagtcaca

SEQ ID NO: 1541 - DNA, 100 bp, Artificial
  Synthetic
aacctttcgcgctgtcatctcccgaatttaagtcgaaagaatgtcctgtagaaacactagagttggtccgtaagccttgtttattcgcggttaaatcagc

SEQ ID NO: 1542 - DNA, 100 bp, Artificial
  Synthetic
aatcaggaactgctgcaaaatatcactttgtcgagcacccacagccatacgcacaccaatttcttgcgtacgttcagtcaccgaaaccagcataatattc

SEQ ID NO: 1543 - DNA, 100 bp, Artificial
  Synthetic
acctaccaaaatttgtgttggtttagtcgtaccatctgcttgtaaaacgcgaactacacttagtgttgctttgccttgttcaataagttgtttttgttca

SEQ ID NO: 1544 - DNA, 100 bp, Artificial
  Synthetic
tattgcatttttaaggcagggtgattgactgcttctagcatttcttgggcttgggcaatgttctgtaccaaaaagcgtggcatatctgtgccattaatca

SEQ ID NO: 1545 - DNA, 100 bp, Artificial
  Synthetic
tttcttgcgttgccttatctacattaatcgtcattggacttaattcatgttcggcagtcaaataactatcttcatcgataatttttttcaacttagaacg

SEQ ID NO: 1546 - DNA, 100 bp, Artificial
  Synthetic
aacgtgctgcttctgccaaatcgccttcgcgctgagctttttcaaaagcaatacgtgctttatcaagttcaacctgagcttgtttagtgccttctaccag

SEQ ID NO: 1547 - DNA, 100 bp, Artificial
  Synthetic
cctcagggcttaaaattgcactgtttaccgagtcggcttccatactaaatggaatcgaatatttattgaggtgagggtggttacgtagtttttggcctgt

SEQ ID NO: 1548 - DNA, 100 bp, Artificial
  Synthetic
cgctcgtgattacatggtccacgtccggcaatcacttcattaaattcgtgccagtcaatctcgccaaactcatagtggcctgtttcttcattgaacttta

SEQ ID NO: 1549 - DNA, 100 bp, Artificial
  Synthetic
atgaagatggtaatggtccatcaaccattggcgtacaatcgtttgtgcaaagtcaccattgggttgttcgcacaacaagaggtttaaaaactcacgttct

SEQ ID NO: 1550 - DNA, 100 bp, Artificial
  Synthetic
gaccgttcattagttcactatcgttgaactcacgagaaaaaatattgataagttgaaagcgttctttgaactgatctttcaaatccataatttgctcggc

SEQ ID NO: 1551 - DNA, 100 bp, Artificial
  Synthetic
gtttaatcacgcgaatcgctaaaggcgcttgtttggcaattttggctgcaagttgaaccgcatattcaacggttaattcggtcggaaccacttgactgca

SEQ ID NO: 1552 - DNA, 100 bp, Artificial
  Synthetic
tcgtcatcttttagaccaagttcacgcatacaagccaaagattgggctgcgaatgcttcattcagctcaatcacatccatctgatctagcgttaaacctg

SEQ ID NO: 1553 - DNA, 100 bp, Artificial
  Synthetic
ataacccaccacagtcggtttacccgttgtaccagatgatgcatgtaaacgcacaatttgctcttgcggtacggcaaacataccaaacggatagttgtct

SEQ ID NO: 1554 - DNA, 100 bp, Artificial
  Synthetic
cggtagaagactgatcctgtaactcaattaaatcacgttgcatcgctgcaacttgcatggcaagcggtacaatatttttagggagctgtgctacatactc

SEQ ID NO: 1555 - DNA, 100 bp, Artificial
  Synthetic
gctctgctgtaacaagtcctagctctacagcaacttgttttaaagttttattctctttataagcagttttcgccacttttgcagagttttcataaccaat

SEQ ID NO: 1556 - DNA, 100 bp, Artificial
  Synthetic
tggctcaaacaactctgcaatttcagtttgcatcatgagtgaccaatcccgtgccatcttgcccgtattcccgacaatcatgccaagcacacttgcaatt

SEQ ID NO: 1557 - DNA, 100 bp, Artificial
  Synthetic
tgcgagactttgaatcgttgtctgtgcaaccacattatgctgatagtcaaatttttcactgaaccagcgggtatgggtagttttaactagctcggctaaa

SEQ ID NO: 1558 - DNA, 100 bp, Artificial
  Synthetic
gcacctgtttcacgcataagtgttggtaaccaacttgttagcaagtaaacaaccacgagtcccatgaagtaagtcacccaaagcaaaaccgtacctttgg

SEQ ID NO: 1559 - DNA, 100 bp, Artificial
  Synthetic
ctttaaagacttcttcagccatatgcattgcagcgtttgcagcaggtaaacccgcatagagtgaactgtgtaagatcagctcttttaaatcttctttagt

SEQ ID NO: 1560 - DNA, 100 bp, Artificial
  Synthetic
ggtacgaccacacccaccaaagttagggtccattgcaccaataaacttatcgtttggatggcggtaacgaccagaagcattggcttgccatacttctaga

SEQ ID NO: 1561 - DNA, 100 bp, Artificial
  Synthetic
tttcttcaaaacgtttcgcaataagtgtttggcgacgtggtgcccattcaatgctatttagaattggatcgttagcatttgcctctgcttcatcttcaaa

SEQ ID NO: 1562 - DNA, 100 bp, Artificial
  Synthetic
gtcctctgacattcccatacgaccaaatttgacctgtacagtattatcaacaaagcccttcttcacccatgcttgggataaacgccaaattttcccgcga

SEQ ID NO: 1563 - DNA, 100 bp, Artificial
  Synthetic
actaatcaatgagtcggtatcactatcagtagagaagctcttactgttcttttgctttttcttgtacatacacatgccaatcgcaatacctgttcctaat

SEQ ID NO: 1564 - DNA, 100 bp, Artificial
  Synthetic
gtttttccgtccatccctaagttggttaaataggtttttgaataaacggtctctacataaaacgttaatgaaccagcagaagtgtatccaaccactaata

SEQ ID NO: 1565 - DNA, 100 bp, Artificial
  Synthetic
catcaccaatggcataaagccctgctacgttggttttacaatagtcatcaattgccacaaaaccttgtggattgagttctacacctaaacgttctagtcc

SEQ ID NO: 1566 - DNA, 100 bp, Artificial
  Synthetic
aagcacctaatgccataattgcaccttgcggtgggttaataatggcatcgaactgtttaatgcctaacattcctaaatttgaaatgctaaagctaccacc

SEQ ID NO: 1567 - DNA, 100 bp, Artificial
  Synthetic
tatggtgactgagaatgctgagctgccgcagagaaacctgcgccaatcatgccacgtacaaccattggtgcttttgcttttccgccaaacatataacgga

SEQ ID NO: 1568 - DNA, 100 bp, Artificial
  Synthetic
gtctttaaggttttcgctgtcaacgctgcaccaattgctaaaggaggcccaccacccacaatcccgttggcaccgagcatacctttatctaaatcggcaa

SEQ ID NO: 1569 - DNA, 100 bp, Artificial
  Synthetic
tggtcgtgactcgatcacatcgggaatcaggtttcgaagctgtgagagctcagcttttagtgtagtggtactcactggtcgatcgccatataaggcatag

SEQ ID NO: 1570 - DNA, 100 bp, Artificial
  Synthetic
gcagctcacgttgaactgcgtcaagttcattacggtggcgaatttctacacctggcgcaataccgtcttcttcatttaacagtttgatttcatcagtcac

SEQ ID NO: 1571 - DNA, 100 bp, Artificial
  Synthetic
acagggcacggcaaggtctcatcattttgtccaagttttttggcattgatcagtgcctgcacttttttatttggtaatttcactttacctaaggcgtcat

SEQ ID NO: 1572 - DNA, 100 bp, Artificial
  Synthetic
tgcacctaaagcagcaccgatgtaaccaccgtttgtaccacccatgcttttaccaacagtataacctgcaccgccacctaaaccaccgccaattgcagat

SEQ ID NO: 1573 - DNA, 100 bp, Artificial
  Synthetic
tatccgccatttgtaccgcccatgtttttaccaacggtgtaacccgcgccaccgcctaaagcaccaccaatagccgcttctgtacggttacgacggtcgc

SEQ ID NO: 1574 - DNA, 100 bp, Artificial
  Synthetic
agcaccgaagccaatcatacttaaaatcgcaacaattttaatgcaggaaaataagaactccgattccccaaaaaagcggacatttaccaagttaatgccg

SEQ ID NO: 1575 - DNA, 100 bp, Artificial
  Synthetic
ggtagttggatgtgtacaggacggcgttcaaggaaacactgacgcaatacgcggtcaatttcagaagctgcatttgcaggagttaaacgagtttgggcaa

SEQ ID NO: 1576 - DNA, 100 bp, Artificial
  Synthetic
cataatgtgctgccctgttcgagttgatcccgtaaacacgactttttgcacatctggatgagaagataatgcttcaccaatctcaccagcaccaaccaca

SEQ ID NO: 1577 - DNA, 100 bp, Artificial
  Synthetic
atttccgcgcggccacgccattcttttaatttattactgtcattgtcataaattggataagtgctttgggcaccagtttccactttcacttgtgggtatt

SEQ ID NO: 1578 - DNA, 100 bp, Artificial
  Synthetic
tcgttgtaagctgatctagagtttggtggatgagcttagaggtctgaattgcatttgcacccgaagataaagaaatacccaaacctgcggcaggatagcc

SEQ ID NO: 1579 - DNA, 100 bp, Artificial
  Synthetic
gcatcgcttcaatctgcgcttgcaaaacagccaatggagttttcaattcatgagaggtatctgcaacccattgacgtcgtgattcttcatgctgatgtaa

SEQ ID NO: 1580 - DNA, 100 bp, Artificial
  Synthetic
ctccaacttgaacattgacagtttgtccaacagctttaccttcacatgctttttgaatttgctcaaaacgagctttacgctctgcacggtgttgttccca

SEQ ID NO: 1581 - DNA, 100 bp, Artificial
  Synthetic
ggctacgccactaacaagaccacctggttgtacgttgacttgagcagatgcacctgcattaacgcccgcactttgtgcaaaaatagaggcagaagcaagt

SEQ ID NO: 1582 - DNA, 100 bp, Artificial
  Synthetic
caccgtgaataatggttgagcatttactacgtgcacctgtattggcatttacagaactacggacaatcactgaggtcactggcattccgccaattaaacc

SEQ ID NO: 1583 - DNA, 100 bp, Artificial
  Synthetic
gcagcagaaacttgctgtacttgtccgctattgaccaaatcgctaatagaacctggttggccgttgacggttgtagtcacttttactttagataagcttt

SEQ ID NO: 1584 - DNA, 100 bp, Artificial
  Synthetic
gatttcacgttcgtttctgcctacatcaccgctaaggtaaaagtcagagttaggaacgaagtactcaacgcctacgccatattgagtgtcttttgtgccg

SEQ ID NO: 1585 - DNA, 100 bp, Artificial
  Synthetic
tggttgcagttaaggttccatccttctgttccgtaaattttactacggctttgggcttattggtttggtcatcaatcgttttccataccgttccgtttag

SEQ ID NO: 1586 - DNA, 100 bp, Artificial
  Synthetic
ccgcaaaatcttcagctttctcaactttactcatgcctacacttgaaccttcatgtacaggcttgataatgacaggcaaccccaattcagcaatcactga

SEQ ID NO: 1587 - DNA, 100 bp, Artificial
  Synthetic
tcacctccacgctgtaaggtgcgtgctaaagccaaacggccatctaaataaactgccagattggtaatacctgcaccaatatcgacaagacagacaccat

SEQ ID NO: 1588 - DNA, 100 bp, Artificial
  Synthetic
cgcgaataattttttgctcaccgtctacacctgacagttgcttattcaactgcatttccaagccttcgataccttgaccttcactattggtcaaaccaat

SEQ ID NO: 1589 - DNA, 100 bp, Artificial
  Synthetic
gcaacaatgcgggctttgtgagcacatgaacgataaacagcctctgctaaaaggtcagcatctcttgcaactaggccatccatattttcttcaagccaaa

SEQ ID NO: 1590 - DNA, 100 bp, Artificial
  Synthetic
aggagtgatgcttttgcattttctaacgttgcacggttcgttctagagtcgagctcataaagcgcctgaccttcacgaacatagcttccttcagcaaata

SEQ ID NO: 1591 - DNA, 100 bp, Artificial
  Synthetic
ttttcatatttagggtcaatacccgtcaccataatacctgccacttgcccttgagcagttaacataccttgcaattgggtaaaaggtgcaactcctgtca

SEQ ID NO: 1592 - DNA, 100 bp, Artificial
  Synthetic
ttccaataccccacttcatctggcttcactttataatggttattcccaatttggacatccaccatatcaagcggttttccagattttactaagccaatga

SEQ ID NO: 1593 - DNA, 100 bp, Artificial
  Synthetic
cggatcgactggcaacttgggtggttgttcagttttaagattaagtgcaccagctttttcttcaatagtttctgcgcttacaagcattcgtggaaactgg

SEQ ID NO: 1594 - DNA, 100 bp, Artificial
  Synthetic
agatggtggtaatgcaacccctctttgaaccgagaaacttaagccatttgcctgatttggaccatgatatggatcttgccctaatataacgactttcaca

SEQ ID NO: 1595 - DNA, 100 bp, Artificial
  Synthetic
gtagtacggcggtcatcgatcgggaagttaaagtagggaactgctagaactggaacatcttttacatatagttttgttccgcgcgtaacaccgcgcccag

SEQ ID NO: 1596 - DNA, 100 bp, Artificial
  Synthetic
caatcgtttgtccttcaccgcgtgcaatacctttatcagcacttatttgttgctgaaacttagacggtctacctttagcagtgatcgtttgaatttcacg

SEQ ID NO: 1597 - DNA, 100 bp, Artificial
  Synthetic
cactgctttctagccaaccaattgccgacatactatgcatcatcgcatcattttgtcctttacggcggtgttcataacgcattaaggtttgttcatgtgc

SEQ ID NO: 1598 - DNA, 100 bp, Artificial
  Synthetic
ggttgtgcctaaggcaaatttaacacccgcttcttcaagattctgctggaatgctgaagcaatgtgtgaaggtaataaacggcctaatggttgaggcgct

SEQ ID NO: 1599 - DNA, 100 bp, Artificial
  Synthetic
aacgactgcccctgcttcttgtaaaacgttagccacttcgatattcgactcttcatcgaaacgggcacgtaattcaattaccgccgtcacttctttacca

SEQ ID NO: 1600 - DNA, 100 bp, Artificial
  Synthetic
ttccggcacagcccaaactgcaattgctacaacaataatcacccattgtaaaacaggcataagctgacgctgagcaagttgttctctagccaactgcaca

SEQ ID NO: 1601 - DNA, 100 bp, Artificial
  Synthetic
ttaccccacggttcaacgtgatataaccggcaattgattcaccatgaactggttggcaacactgcgcaatatgtagctcaacattgtctaaaccatcaat

SEQ ID NO: 1602 - DNA, 100 bp, Artificial
  Synthetic
cgaccaccgcataccagacacttattcctaagcggtcagaaagcatggcttgagttttgacccagtcacggaccgttactaacgggaaatctggaccata

SEQ ID NO: 1603 - DNA, 100 bp, Artificial
  Synthetic
gtaagcacgttttaattctgcaacgaagccatcttttgccaattgctgcaaaacagaaacttccggagaaacttgtccttttgccgccatatgctcttca

SEQ ID NO: 1604 - DNA, 100 bp, Artificial
  Synthetic
acatcatggttgaaccagtgaagtaatggcgcatacgacgggtgttatctgcctcaatactcaagtccagctcatttaaaatgatttggcggtagtcttg

SEQ ID NO: 1605 - DNA, 100 bp, Artificial
  Synthetic
ctggttttggcacagaaactcgctgaggcattccatcacgactcacttcagtttctgctgcacgctccgcaatacttggcataccttgatcgcttaaatc

SEQ ID NO: 1606 - DNA, 100 bp, Artificial
  Synthetic
gtggtaaaatgagggttagaaattcaggtaaacgatatccaatgatgctaaacaagatactggcatctagtcgcccctgtgccgccacaccaaagtattt

SEQ ID NO: 1607 - DNA, 100 bp, Artificial
  Synthetic
ggcattaagcgcaccgtcacgtaaacctttttgatccatgctgataaaccattgtggtgtagcacggaaaataatcggagtcttatgacgccagcagtgt

SEQ ID NO: 1608 - DNA, 100 bp, Artificial
  Synthetic
cgggatcccccatgtcgttacaccaccactaaaggaactcatcaaaaattctttgttgtagcccacaagtagcataaagcccacataaagcactaacatg

SEQ ID NO: 1609 - DNA, 100 bp, Artificial
  Synthetic
gtgtggaagacctgctgtaccaaacatgagtgctaagccaagagataaggcatcaatcgggtttgcggcaagtttacctggtcccataatttttgcagca

SEQ ID NO: 1610 - DNA, 100 bp, Artificial
  Synthetic
aactacagggccggtgttgtagataatactgcctgagccaacaaagagagagccaccaataacccctgcaatcgagatcatggttaagtggcgtgattta

SEQ ID NO: 1611 - DNA, 100 bp, Artificial
  Synthetic
gattttcattggttgtattcggtacatacggttgagttgaaccacgtccaataacgtaaatattttcctttttaaaaccgtgagtcaagaagaggttcgc

SEQ ID NO: 1612 - DNA, 100 bp, Artificial
  Synthetic
cctaaagtttgtactacagcatctttaaaaccagctttgtcgagagcctgaataacttctgcctgatttgctggctgagcatagttaagctcagctgaaa

SEQ ID NO: 1613 - DNA, 100 bp, Artificial
  Synthetic
ggcttcaccaagcatcgttgtatcattatatgaatcacctgctgcaatcacacggaaattcaaaccatgtagtgctttaaccgactcacgcttttggtca

SEQ ID NO: 1614 - DNA, 100 bp, Artificial
  Synthetic
gcaattaagccaccaatggcatatcctaaaataatggatggtcccgcagattgaatcacttgcgccgagcctaaaaataatccggtaccaattgctccac

SEQ ID NO: 1615 - DNA, 100 bp, Artificial
  Synthetic
ttttcaagccactgattcatacatcctaatgtcggccctactcccacacgccagcctttatctaaatttgaacccgcttggacataagtttgtacctgcc

SEQ ID NO: 1616 - DNA, 100 bp, Artificial
  Synthetic
cagcagtaagtgcattcatatcgaatgtttcaccacttgcagttttacggccatgaaattgacgaccataccacgatgccatgccagtttggctaaactt

SEQ ID NO: 1617 - DNA, 100 bp, Artificial
  Synthetic
aacagaattgctgtaaccactaaaccaaatatcagcgtggtgtaacctaagattgtactaatgcctgtaaccactgttccaagccatacaattgccatca

SEQ ID NO: 1618 - DNA, 100 bp, Artificial
  Synthetic
atggaatgatttgaccaaccacacctagtggttcatggaaatggtaggcaatggtatcttcatcaatttcagagatgccgccttcttgagcacgaataca

SEQ ID NO: 1619 - DNA, 100 bp, Artificial
  Synthetic
taagccaatcccttttgcacagtcatgagatgagccaccgcctaacgacacaataaagtcacagccattttcgttataggcattcacaccgttgtggaca

SEQ ID NO: 1620 - DNA, 100 bp, Artificial; identical to SEQ ID NO: 1530
  Synthetic

SEQ ID NO: 1621 - DNA, 100 bp, Artificial
  Synthetic
ataatttgagttgctttagcagagcgttgtttcaaggcaccgtctgtgcgtagcataagccaagcgccgccatgagcacacaacatagaaaggctgacaa

SEQ ID NO: 1622 - DNA, 100 bp, Artificial; identical to SEQ ID NO: 1531
  Synthetic

SEQ ID NO: 1623 - DNA, 100 bp, Artificial
  Synthetic
caatacgagttgtagtttcataacctaggtatgggttaagtgcagtcacaataccaattgaattttcaaccaaagctttacagtgttcagggttcgccgt

SEQ ID NO: 1624 - DNA, 100 bp, Artificial
  Synthetic
gaacttctgcaatcgcattggcataagttttaccactttcacggcaaagtaataccatcaactcttgaatacggctttccatgaggtcagctgcgcgttt

SEQ ID NO: 1625 - DNA, 100 bp, Artificial
  Synthetic
gagaagaactactaagttgttgagctgttggtaatgctaggtctagcgccgcgccaggttggaaaaagtttgctaaacccataccgatggcaagtgagac

SEQ ID NO: 1626 - DNA, 100 bp, Artificial
  Synthetic
ccatggggtcagattcattacaccactacataacaacataagtgctgtcatgatcagtgtattcataccgaggcgttgataaagagggagcatggctgcc

SEQ ID NO: 1627 - DNA, 100 bp, Artificial
  Synthetic
ttgctgtaagtactggacggcgccagaacaaaccacggtagtctgcaaggctttgcgcttcatctacgttgttatatgggctagacattaacgctactgc

SEQ ID NO: 1628 - DNA, 100 bp, Artificial
  Synthetic
atcaagatacccgccaagtctacagaacccgctgtaggtgcttgagcatgggcatccggtaaccagccatgcaatgggaaaactggtaacttcactgcaa

SEQ ID NO: 1629 - DNA, 100 bp, Artificial
  Synthetic
aggctgagcatcacgcgagctaataagcggtgaaccacattcgctacaaaaccaacggtacacaccattcacagcaaattttttgacaaggtcttcacct

SEQ ID NO: 1630 - DNA, 100 bp, Artificial
  Synthetic
taatattggtggtttcggttaggatggctggtgagctgacttgcaaacgacccatcgcaaacaaaaataagttaaccgcatagcccagcactgctaagcc

SEQ ID NO: 1631 - DNA, 100 bp, Artificial
  Synthetic
agaagccactaaaaggtggtaagcctgcgagcatcatggcaatcaggaaataagtcagcatggctgctttttcttgtttaattctcggtgcaatctttaa

SEQ ID NO: 1632 - DNA, 100 bp, Artificial
  Synthetic
aaatttccatgagtggagcctcatagcgttgtttgatgtcttgcacatcactttcagtattttctgtgctaagagagtggaccaaaatatcaccacgctc

SEQ ID NO: 1633 - DNA, 100 bp, Artificial
  Synthetic
gtgtgagctgaacatccagcatcatattggcatctagtaaaagattggccattttttgattacgctgatcacggatgtccacttgtagctgtccgttctg

SEQ ID NO: 1634 - DNA, 100 bp, Artificial
  Synthetic
cttcgattgcttgatcttttttgcttgcaattaaagcttctgcttcttcttgtaagcgttttaactcttcaacagataattcactaatatccggtttcat

SEQ ID NO: 1635 - DNA, 100 bp, Artificial
  Synthetic
aggccaatttcttttgcgtactgttcaaccaatgccacttgagcatcttcacggcctgttaggcgtaagtagtcgattgtgttttggtcgatgtagaaca

SEQ ID NO: 1636 - DNA, 100 bp, Artificial
  Synthetic
cgagcaagtgagcaacttcttcaaactcgctacctgccgcaaggtcaagaatgtcatagccacgatagtgcaagtcgttaccgctacgtcctacggtaca

SEQ ID NO: 1637 - DNA, 100 bp, Artificial
  Synthetic
gtttcatacacagtttcggctgccttgttcatggcacggaaagcagaaagcggataaagcgcaaggcttacatcggcagatgctaactcttcagtggtaa

SEQ ID NO: 1638 - DNA, 100 bp, Artificial
  Synthetic
tgcctgcaattgattttgcagcttgtggattctcaagtaagtaagcagagaactctttgttcattgcttgctctaccgctggttttacctcacttgatac

SEQ ID NO: 1639 - DNA, 100 bp, Artificial
  Synthetic
taactatatgtgactggcatttcaaaagtgacttgaactccaaaacggaccacttccaatagcccccaaaaaaacatccctgcaagcataaaaccaagcc

SEQ ID NO: 1640 - DNA, 100 bp, Artificial
  Synthetic
caccaagactactgccgactaaagccacctcttgtaaagactcaatcagctctgaaacctgtgctactacctgttccggagatctatttaaatctggcaa

SEQ ID NO: 1641 - DNA, 100 bp, Artificial
  Synthetic
actgtggttcttggaacttaagcgataaaatatagttcacgccatcccaaacatcttcagccgaaagtttaagattacgtggtaataaattacgtaactc

SEQ ID NO: 1642 - DNA, 100 bp, Artificial
  Synthetic
ctgtgttgcagccagtgggagtaacgtacggttaatcagtgttgatttacctgaacctgaaacacccgtgacacaagtcataatgccaagtgggatggtt

SEQ ID NO: 1643 - DNA, 100 bp, Artificial
  Synthetic
agtcaacatttggatggtaacgaacaccacctttaccaggaccacgagacaagttgtgttgtacacggtagccttcaaagtgctggattgaaccgtcgtc

SEQ ID NO: 1644 - DNA, 100 bp, Artificial
  Synthetic
acccaatctcagtcggcatctctaaattaatactcatccggtcagcatataaacctgcttcatggatcagttcaggcgatgcacccggaattgtttttag

SEQ ID NO: 1645 - DNA, 100 bp, Artificial
  Synthetic
tacgttgctcatcataaatgagccaacgctgatcttgataacgccgtttaaaatgcggctgaatgagtggtaagacattaaaatcaggacgaaccagact

SEQ ID NO: 1646 - DNA, 100 bp, Artificial
  Synthetic
cctagtgactgtaaggctgcttctgcttctgcaacaggtgagttcgaaacaaattgaatctgaggcagggccgcagcgctagaagttccttgtgccaaag

SEQ ID NO: 1647 - DNA, 100 bp, Artificial
  Synthetic
taataatttcataatgatgtttggcaaaagctgtagtgacttcatcaaccagacgcttcataacacggccacgcaatgccgaaattttttgttgccatgt

SEQ ID NO: 1648 - DNA, 100 bp, Artificial
  Synthetic
tatctgcatattgttcaggtttcggacgtacttggttgtgtacagcatcgcctgcttggttactttcattcggcattggaaatggcaatttcaccaaagc

SEQ ID NO: 1649 - DNA, 100 bp, Artificial
  Synthetic
ttagatcatttgaaccacagtacatacaacgtttaaccgagtaaaagtttaaacgaggttcgatttttcgccatgctttccatacaggttgtacaaatat

SEQ ID NO: 1650 - DNA, 100 bp, Artificial
  Synthetic
actttgtagctgtttgactaattgatagccgattccccatacctctttgactgatgtctgttgcatgaggtcttccataattaatggatctaaggtgatg

SEQ ID NO: 1651 - DNA, 100 bp, Artificial
  Synthetic
atttctcgataagctctgctttagagtaatctcggcgagtgagtaaagcaaaagcatatgagcgtaaacgttggccagtaagaggagggcgctgctgaga

SEQ ID NO: 1652 - DNA, 100 bp, Artificial
  Synthetic
cgtttagcattacccgtaattttacgaagtgcctggctcataagacgtgcttgtagacccatatgagagtcacccatctcaccttcgatttctgctttag

SEQ ID NO: 1653 - DNA, 100 bp, Artificial
  Synthetic
ctccgtcacgggtattacaccgaacttacatttaagagcagcttcttgaaaactcggtttttggaaaattgtttcatgacgggcgttataagtatgtttt

SEQ ID NO: 1654 - DNA, 100 bp, Artificial
  Synthetic
tttaaatcgagtgcttgctcaatatcgtcttgcgctggtgatgggaaacccgcagcaacacgttctgtcgccaaaggaatgtggtaaattttatcgttgt

SEQ ID NO: 1655 - DNA, 100 bp, Artificial
  Synthetic
ccctgccctcgcgcttttacctcaacaaaaatcaattcgttaccgcgttttacaatcagatcgacctctccacggcgtgaatgataattactggcgaccc

SEQ ID NO: 1656 - DNA, 100 bp, Artificial
  Synthetic
aaaggtatctttcacttcacgtaccacatccagatatggcatgcccggttttacaatcaccatgtcggcgccttcttgaatatcaagcgcgatttcatgt

SEQ ID NO: 1657 - DNA, 100 bp, Artificial
  Synthetic
ataagagttcaaggcacgtacaggtgtccagtcattacctaaaccacctgcccatttagagagcatcgcgttgtcacgcattgcaccataaatgtcataa

SEQ ID NO: 1658 - DNA, 100 bp, Artificial
  Synthetic
gacttccaaagtgcgatatcgtggttcatgttcacttcttgaggcatccagtggtttgcacaaccatctagatatttttgccaagcccactcatatttaa

SEQ ID NO: 1659 - DNA, 100 bp, Artificial
  Synthetic
attcctcaactaaatcatctaaaaatgcaattcgcacttgcaaatcttcaatgggtgcggaaaatgacgcttgatcatcatgatatggtggtttagtcat

SEQ ID NO: 1660 - DNA, 100 bp, Artificial
  Synthetic
ttggcaaggcatagctgcgccctgtttcatcaaggaagtaaactcgctgattggttttcccgacagcatgacttaaatattggtccccagcacggtagtt

SEQ ID NO: 1661 - DNA, 100 bp, Artificial
  Synthetic
gtcaccacgtgcttttagaataggaaggatgccatatttctgatagccgatatttaaagttgttgtggtgtgctcctcttttttggcacaaccacctagc

SEQ ID NO: 1662 - DNA, 100 bp, Artificial
  Synthetic
tctccagtaacgccaacatcgagtgagccaacagctaaggcttctaaaatttgagggccagcggggaactcattccaagtgattttggcatttggaaatt

SEQ ID NO: 1663 - DNA, 100 bp, Artificial
  Synthetic
ccatttgtggcccccaatatttaactttaagcgcttgagtatcctgaatatgctttactgtttccggcgtagcaatgatctgtacattcgggaaatactg

SEQ ID NO: 1664 - DNA, 100 bp, Artificial
  Synthetic
aacgagggccgtggttgtaccgtgttttaagagttcctgaacaaagaactgggcaatttcgcttgcatatgttttgtcttgaaactggatttcagttggg

SEQ ID NO: 1665 - DNA, 100 bp, Artificial
  Synthetic
tttaacgtctcgacttgaagtggtaccgccgccatagctagacactgtcataaagtcgagttcatgtggtttggtaatcgtacggcataagtctgccatg

SEQ ID NO: 1666 - DNA, 100 bp, Artificial
  Synthetic
gaatacctaaaccacggcgataaagcgtcttgaaacggccaatattagaagtgccatattgagctagacgaatacgttcttcattgtcatctagcataca

SEQ ID NO: 1667 - DNA, 100 bp, Artificial
  Synthetic
gtagtgctctgaaggcttggttttaatctggaagttgacttgatggtaataaacttggctttggccatagttctcatcatattgagaaactgctttaggc

SEQ ID NO: 1668 - DNA, 100 bp, Artificial
  Synthetic
caaacaattcaatgatttcttcattacgcattcgaatacacccatgtgacattggaacccccatcggttctttatcaggtgtaccatgaatatagatata

SEQ ID NO: 1669 - DNA, 100 bp, Artificial
  Synthetic
aaattgcatactgcccataattgcactggctgttcctgcacgagcaccttgctttgacatggctagagccatagcatttggtccagttaaaccaattcct

SEQ ID NO: 1670 - DNA, 100 bp, Artificial
  Synthetic
tttttaatctgacccacttgtttagcaccggcatttcgctctgcctgtaacttttcagtttttgattgcaagtctttacggcgagtctctaaagatgccc

SEQ ID NO: 1671 - DNA, 100 bp, Artificial; identical to SEQ ID NO: 1591
  Synthetic

SEQ ID NO: 1672 - DNA, 100 bp, Artificial
  Synthetic
cgattggcaatacgcggtgttccgcgtgaacggcgtgcaacttcttctgcaccctcaactgtaatgggtacatccatgaggtttgcagatcgtgacacga

SEQ ID NO: 1673 - DNA, 100 bp, Artificial; identical to SEQ ID NO: 1646
  Synthetic

SEQ ID NO: 1674 - DNA, 100 bp, Artificial
  Synthetic
accaacggcgctgcaaaatattacgtgaacggtcatctagctggttcattgcgtcatgcaaagcagatgtactttgttcttcccaatcctcattttctac

SEQ ID NO: 1675 - DNA, 100 bp, Artificial
  Synthetic
aacatatcacaaacttcacgcacagctccacggccacccatcgcctgtgttaccaaatccgcacgacggcgcacttcctcatgtccgtttggaacagtaa

SEQ ID NO: 1676 - DNA, 100 bp, Artificial; identical to SEQ ID NO: 1512
  Synthetic

SEQ ID NO: 1677 - DNA, 100 bp, Artificial
  Synthetic
gcctgcaacacccaagaaataccaatgacttttagctaactcaccatattgaacttgctctaaagcatcatgaagtaatttactttgtgcataaaaagca

SEQ ID NO: 1678 - DNA, 100 bp, Artificial
  Synthetic
cagccttcagcaaagagagtgtatttagcgtgaagttcataacccggagtaaagttatgtgtaggctcgccatctttaccaatacccatgtcaccagttt

SEQ ID NO: 1679 - DNA, 100 bp, Artificial
  Synthetic
cagtagaatactttacggtttggttctaagtgacgttgttgtagctctttgtttaaagcaatagtttgcgagtctacaactgcacgcgttaaggtcactt

SEQ ID NO: 1680 - DNA, 100 bp, Artificial
  Synthetic
ttaattcgatagaaacatcatgaccacggaagtcaaaacgtgttgcaatctctttttgggtgttttgtacagcgtgattaacttcaaataactctaattc

SEQ ID NO: 1681 - DNA, 100 bp, Artificial
  Synthetic
cgtgctcgctaatgcctgttgggtatattcattaccattacggcgtaaaaaatccattgctgcatcacgatccgcattgtcagcaaactgaacagtgatc

SEQ ID NO: 1682 - DNA, 100 bp, Artificial
  Synthetic
ggctcgcaagaccagttacaaacgcttggaaaggtgtaaggccatgctcatcttcgccttctgtacggctgcttttcataacacgaatactttgcaagaa

SEQ ID NO: 1683 - DNA, 100 bp, Artificial
  Synthetic
gttgttgctgtacttgacgttgttcttgaactaatgcttttaatgcttcaacttcttgacgaagctttcgaatttcctctttatcagaagttgccgcatt

SEQ ID NO: 1684 - DNA, 100 bp, Artificial
  Synthetic
acgtcaaggaagtttgcaggctgaccaccataaagtttaatgatgtccatagttgccattgcaagaccagcaccgttaaccatacaaccgatgttacctt

SEQ ID NO: 1685 - DNA, 100 bp, Artificial
  Synthetic
gtttcagcatccatgtttaatgtagttttggcatttgaagacaaacctttttggattttacccccatctaacgctaattcggtatttccagaagcatctg

SEQ ID NO: 1686 - DNA, 100 bp, Artificial
  Synthetic
ttaagcagtaaccagcttcatcagtatggcctgtttttaagccatcaacacttgggtcagtgtaaagtaaagcattacggttaccttgtttgataccgtt

SEQ ID NO: 1687 - DNA, 100 bp, Artificial; identical to SEQ ID NO: 1531
  Synthetic

SEQ ID NO: 1688 - DNA, 100 bp, Artificial
  Synthetic
ccaataaagtcaggatcttcgttacccactaatgcccattgtgcagcaattacaggttcaggattttctgttccatctacaaagccaataatcgcacgcc

SEQ ID NO: 1689 - DNA, 100 bp, Artificial
  Synthetic
gtatagatcgggtcatttttgttcgcttcagcaacacccaataagttgacataaagcttagtagactgatcgattggctcacggaagattgcgtctttca

SEQ ID NO: 1690 - DNA, 100 bp, Artificial
  Synthetic
tgactcgcggttgatttccacagactcaagaatactcattaaggtttgccccttgtaccaaggagtatgagctgatggatttacaacgttatcgccattt

SEQ ID NO: 1691 - DNA, 100 bp, Artificial
  Synthetic
ccaaagttcaggacgttggtttttaggatcccaacgatgtttactatcacggaatgaatacacacgctctttcgcacgtgatttttcttcgtcacggcgc

SEQ ID NO: 1692 - DNA, 100 bp, Artificial
  Synthetic
aaccagttctttcctttcttcttttctttttctctaataatccccatcatattttcttttactgcccccacataatcggcatcatcatgttgaatatggt

SEQ ID NO: 1693 - DNA, 100 bp, Artificial
  Synthetic
taagtactggacggcgccagaacaaaccacggtagtctgcaaggctttgcgcttcatctacgttgttatatgggctagacattaacgctactgcaccaaa

SEQ ID NO: 1694 - DNA, 100 bp, Artificial
  Synthetic
tgttttaatcaagatacccgccaagtctacagaacccgctgtaggtgcttgagcatgggcatccggtaaccagccatgcaatgggaaaactggtaacttc

SEQ ID NO: 1695 - DNA, 100 bp, Artificial
  Synthetic
agctgttaccattgttgctgcgtggattaatgcagaaacaggtgtaggacctgccatcgcatctgctaaccatgtttgcaatggaatttgtgcagattta

SEQ ID NO: 1696 - DNA, 100 bp, Artificial
  Synthetic
cacgcctctgccgcagcaagggttaaaatcagaatgaacatgacttgtccatctggttgtgcccatacgctacccgcaagaacgaatgctaacgctgcag

SEQ ID NO: 1697 - DNA, 100 bp, Artificial
  Synthetic
cggataccaacgtccgtcttctttttcagctttttgcagtgaaatacagccaaccggacatgcaaccgcacaaaggttacatgccacacaacgctcttcc

SEQ ID NO: 1698 - DNA, 100 bp, Artificial
  Synthetic
ttgttatttgatgaccaaccaccgaataacactgcataaaccgcaataccagccattgccataaagaacaacaaaccgatgctcatgtccgcaacaccca

SEQ ID NO: 1699 - DNA, 100 bp, Artificial
  Synthetic
cgttgtgcacgaccttcttggcttacgacagtaccatcaccttcggcaaagcttgctgctgaaagtacaatatcagcctgtttcacagtttcagtttcac

SEQ ID NO: 1700 - DNA, 100 bp, Artificial
  Synthetic
cgtcccaatgttttgcaagttccgcaaatgcattatcaatttcagcatcaacggcaacatcacatggaaacacaagcttagaaccgaattgctcagcaaa

SEQ ID NO: 1701 - DNA, 100 bp, Artificial
  Synthetic
aattgtatgttcacctactataggcataatggtaaaagaaagtagagaggcgacaccaagttgaataatggtgacgcgacgcaaatttacctttccagca

SEQ ID NO: 1702 - DNA, 100 bp, Artificial
  Synthetic
caaaaagataactaaaaggctgtttggttacactcaccttatgactaggcatttgtttctttaagccaacccaactcagcagtgcaagtaaagcaattgc

SEQ ID NO: 1703 - DNA, 100 bp, Artificial
  Synthetic
taactctataaagtgattaccgccgcctaaagtgcccaactgtttttgccatgttgcctcaaactgacgaagcattcggacaagacccggatgcttttta

SEQ ID NO: 1704 - DNA, 100 bp, Artificial
  Synthetic
ccatagcagctacattttgcccaagtggcgtgagggaataatcgacacgaataggggaagtatcctgaatttttcgttcgataaaaccgtctctctctaa

SEQ ID NO: 1705 - DNA, 100 bp, Artificial
  Synthetic
gtaattcttcacccgcatcgccaatgagtttaattggatagtccattggaaatacccaaaggtcttcacggagttcgcgagatggagtgcggtctaacat

SEQ ID NO: 1706 - DNA, 100 bp, Artificial
  Synthetic
gacagctttagtttgagcccatgcagcttctaattcagcaaaacgaacttttgcaacttcagggtctggacctgaatcaccttcagaatcatcatcacct

SEQ ID NO: 1707 - DNA, 100 bp, Artificial
  Synthetic
atcgacttctccttgttgcacagcatttaacaaatatcctgtcgggtgagtttgaagttcaagcggcagattcggatgttgctgcatacattcattaagc

SEQ ID NO: 1708 - DNA, 100 bp, Artificial
  Synthetic
ggtgtcgcaataatcttttggcccacttgaggtgctttgaaatattgcaagatttctacaacatctctcgggaactgatcttctgtttcctgatgtccac

SEQ ID NO: 1709 - DNA, 100 bp, Artificial
  Synthetic
gccatttgtaccgcccatgtttttaccaacggtgtaacccgcgccaccgcctaaagcaccaccaatagccgcttctgtacggttacgacggtcgcttgct

SEQ ID NO: 1710 - DNA, 100 bp, Artificial; identical to SEQ ID NO: 1617
  Synthetic

SEQ ID NO: 1711 - DNA, 100 bp, Artificial
  Synthetic
gtcatctgcatcatatatgcaatcattggaacagtcgcaatcagcaaaccaccctcaaaaccaatcgcatgtaaaatccgcacagagatcgttctttccc

SEQ ID NO: 1712 - DNA, 100 bp, Artificial
  Synthetic
caccgagtgcacccatcggtaaaatcaaacccgccataatcagcgaataaatatcaataatccataaaagctgattggcagttaaattcaatgctgcact

SEQ ID NO: 1713 - DNA, 100 bp, Artificial
  Synthetic
atcacctgccatccacctatttttttcgaaagtactccgccttctgcatagccaaatccacacaaaataattgcaataagcatgtataaatcgccgatgc

SEQ ID NO: 1714 - DNA, 100 bp, Artificial; identical to SEQ ID NO: 1556
  Synthetic

SEQ ID NO: 1715 - DNA, 100 bp, Artificial; identical to SEQ ID NO: 1557
  Synthetic

SEQ ID NO: 1716 - DNA, 100 bp, Artificial; identical to SEQ ID NO: 1558
  Synthetic

SEQ ID NO: 1717 - DNA, 100 bp, Artificial
  Synthetic
aactgcatgccaaaatgcttcaaaaccagatttgcggtaacgctcggcttgagaagggtcttgggcaataaaattaagtgtaacttcggcaagcgcacct

SEQ ID NO: 1718 - DNA, 100 bp, Artificial
  Synthetic
aagtgctgcacccacaccaaaaatactaaaagtggcccacaactcacctacttcctttcctaacggccctaaaagcccagcttcgaccgatagccccatt

SEQ ID NO: 1719 - DNA, 100 bp, Artificial
  Synthetic
ttaagtaaaagttatcaagatgatctggttcaataataacatctgcgccatattccaagcggctaatagacaatgcgcctgttttaacatggtgcatagt

SEQ ID NO: 1720 - DNA, 100 bp, Artificial
  Synthetic
cctgtacccgataaaagagctgaatctgtgccagttacattttggcgtaatgcaacagtttgaacgttgtctcggctaatgaggttggcaagagtgattt

SEQ ID NO: 1721 - DNA, 100 bp, Artificial
  Synthetic
tctaagccgtctaagtaaactaagcttttaggatctacaaaaaccttaacgccgaattgttcgaaaatttgatcatgttcatcgatatcatctacaaatt

SEQ ID NO: 1722 - DNA, 100 bp, Artificial
  Synthetic
tgtcgcttcatcaagttgttcacgaagttctaaagcggattgtagaaattcgaaatcactaatagattgatcaagatgatgatcttgctttttaagagct

SEQ ID NO: 1723 - DNA, 100 bp, Artificial
  Synthetic
gcttcacgagcagaaacggtgagtaagccatctgcatcaacttggaaagtgacttcaatacgagcttggcctgcagtcattggtggaatgccatgaagta

SEQ ID NO: 1724 - DNA, 100 bp, Artificial
  Synthetic
tattcctcatccgtttactcataaagaaactaataaagaacatcactacaaagtaaatcgtgagtggaatcgcaatacgtaatacatctaaaggtaagct

SEQ ID NO: 1725 - DNA, 100 bp, Artificial
  Synthetic
gtgtcaagcttcctaatgttccggcttgcacaccagttaaatgaaactctgctttaagactagtgaggcttaatgccaaaaaacctaagtcggccccgtc

SEQ ID NO: 1726 - DNA, 100 bp, Artificial
  Synthetic
gtttagggcactgggcaatcgcgttccaataacgttctgtatgacgcaataacatttctgtggaagttgcggttgccatttcttttagatctgcacctgc

SEQ ID NO: 1727 - DNA, 100 bp, Artificial
  Synthetic
gtccccattttgaagtggaataggccaatcgatatggatagcctaagcgtccggcaatagatgacatatttataatcacgcctgcctgtgcttgctttaa

SEQ ID NO: 1728 - DNA, 100 bp, Artificial
  Synthetic
tgagtagatcatcaattggcatatctcttagtaactttttactgagctgtaaggcttggcttggtttgtgagcaagtttaattgccacatcttcaaccac

SEQ ID NO: 1729 - DNA, 100 bp, Artificial
  Synthetic
gctgaaatttgcttgagttaggtacttgtttgatataacccaaacgcgacaaggtatgtgtgaggcgagtaatggttggttttggcaaacctgtcatctg

SEQ ID NO: 1730 - DNA, 100 bp, Artificial
  Synthetic
gaaaagccggtgaagtttgtccaagttcaaatgcaactctgacttcctcttccatagtgatgcctaagccaccatattcttcgggaattgtaagaccgaa

SEQ ID NO: 1731 - DNA, 100 bp, Artificial
  Synthetic
actgactacaatttgaaccttcagaagcattacctaattgcttttcagaaaacttaaattttgatgcaacagaagcataatcttttttaagggtttgacc

SEQ ID NO: 1732 - DNA, 100 bp, Artificial
  Synthetic
cgcatcatagattttaggtcggtcagttttaaacttttctacatccagtggaatcttactttcctctttaacaatatacaaaactgaaccattggcattg

SEQ ID NO: 1733 - DNA, 100 bp, Artificial
  Synthetic
gttttaggaagagcttttagtttctttgcaagttcaacaagggagtcactcgcaataagcgtgcttccagtgaaagcagtataggtgattttagtattca

SEQ ID NO: 1734 - DNA, 100 bp, Artificial
  Synthetic
aaccaaatacccattcaatgccgttaatatccgctaaatgccctagccccgctgcggcaataccacttaccccaaacataaggccaaacattaaacctgc

SEQ ID NO: 1735 - DNA, 100 bp, Artificial
  Synthetic
tagacgatgttcttctacacgtggctgccattcttcggtcaaataatcatcgttggtgtaatattcaaatgcaccacccaatggtgagttgacgtaccag

SEQ ID NO: 1736 - DNA, 100 bp, Artificial
  Synthetic
gctgttccatttaaatcttgtggaagttgctggcgttgaatcgctcttccgttgacatataaatcatgacgttcctgtggcacatactcggttgcttcaa

SEQ ID NO: 1737 - DNA, 100 bp, Artificial
  Synthetic
cggtgcgggttgttcatttgcatcgataccaaaccagatgaagattgcaccatgctgttcaatgaccggatagctctttaaacacttggttccagtcatt

SEQ ID NO: 1738 - DNA, 100 bp, Artificial
  Synthetic
cttgttcaactgtgtgttgccctaagttaagcatcatcacaacgaatacgaacaagaccataatcgcaccagcataaacaatgatttcgagggcgccggc

SEQ ID NO: 1739 - DNA, 100 bp, Artificial
  Synthetic
cagtctggttatcttgaaccaatacttccgttacaagtcctgctacatctgaagagacctgaataacgtcaccacgaactcgaccatcacgtgtccacgg

SEQ ID NO: 1740 - DNA, 100 bp, Artificial
  Synthetic
tgggtaatgcaatccagccttgtgcaatccatttgttggttaagggacttaaccagcgaaaacatatatatgcaaaaatggcttggacgagcaaagcagg

SEQ ID NO: 1741 - DNA, 100 bp, Artificial
  Synthetic
gctgatgttcagaagccgaatcatttaagttcaagaaatcattttcaaactcgtcaggtaactgcagaatattttcatcagtcatctgatctttttgttc

SEQ ID NO: 1742 - DNA, 100 bp, Artificial
  Synthetic
gcgcttttacaaggtagtcaaattcacctgaaatgaggtgacattcgagtacttcaggaatctcaactaagtctctagccacctgatcaaatacatcgcc

SEQ ID NO: 1743 - DNA, 100 bp, Artificial
  Synthetic
atagttgagctgcacgagacaccaagccttgtactttaatacctaaagcgatttcaccttgagtggttacttcaataatcgaatagctacgttgttggta

SEQ ID NO: 1744 - DNA, 100 bp, Artificial
  Synthetic
ctgcgggaactgccaggcttcctgattgatacgccgcgcccacagcacctgccccgcctcgttggcgagaatgatgccgacattcgggcgaaaaccatcg

SEQ ID NO: 1745 - DNA, 100 bp, Artificial
  Synthetic
atgcagccctcggcgcggtcgtcgtccaggctcggccagcgggtgttctggctgaacgcggtctgggtcgggatgcccgccggaccggccttgaagaagg

SEQ ID NO: 1746 - DNA, 100 bp, Artificial
  Synthetic
cgcaggtcgcggtcgtcgacgccacggtaggcgcggccctgctgggcgaggtagagcagcgacaggcgcgacggttcgtcgtagcgcgaacggatacgct

SEQ ID NO: 1747 - DNA, 100 bp, Artificial
  Synthetic
tgcttggtcaggtactcggcgagacggttggcgccgtgcttggtacgggtgaagaccagcacctgttcccaggcgccgacggttaccaggtgcgccagca

SEQ ID NO: 1748 - DNA, 100 bp, Artificial
  Synthetic
tgctggttgagcaggcgctggcagcggaacagcacgtcgctgtggaagaacgcctcggccagccggttgtacgggtagtgcgaggaactggcgcgctcgt

SEQ ID NO: 1749 - DNA, 100 bp, Artificial
  Synthetic
gcgtgtcggacttcttcaggcgctcggacttgtgcgccaccgccagcaggtgcaggtcgtggttgcccaggacgctgaccaccgactcgcgcatggcata

SEQ ID NO: 1750 - DNA, 100 bp, Artificial
  Synthetic
agggccgggtagctcgccgggcgtacctcggaggccttggggatcggcacccagggctgcatgcgccagaggtcgccgcgggtatcgggatcgtcggcga

SEQ ID NO: 1751 - DNA, 100 bp, Artificial
  Synthetic
ttcgccgagggtggcgtcggccggcttgtccatgaccgccttcagctcggcaacggcgtcatccagcttgccgctgtcgaccgcgaccttggccacgaac

SEQ ID NO: 1752 - DNA, 100 bp, Artificial
  Synthetic
ccgatctcgcgggcgatggcgaccttctcgtcgctggagaagggtagcgccgagctgtagtagtcgagcaggctaagggccttttccgggtcctgccgcg

SEQ ID NO: 1753 - DNA, 100 bp, Artificial
  Synthetic
gatcaccttgaccgcagccgaggactgcacggtagcgatggcgttaccggcgtagatcggacgcttgaaggtgtcggggctgaccacttcgacgatctcg

SEQ ID NO: 1754 - DNA, 100 bp, Artificial
  Synthetic
tctgctgcttgagcaggaacaccgcctggctttcctgttcgctgaagatcgccaccaggacattggccccggtcacttcgcgcttgccggaactctgcac

SEQ ID NO: 1755 - DNA, 100 bp, Artificial
  Synthetic
tggcgtcctccgttccttcgacttcccattcaccggcccagtcctcgccgaacagttcgctgggatgctgggtgcggctggcgccgttgccgcagcccat

SEQ ID NO: 1756 - DNA, 100 bp, Artificial
  Synthetic
gaacaggctcttgtcgaagaactccggggcgttcaggccatgcaggatcgacaggcgctgggccatcacggtgcagaggttctccagttcctcggcggtc

SEQ ID NO: 1757 - DNA, 100 bp, Artificial
  Synthetic
gctgccgtccaccgtatggttggcgtgctgctcgaagggcagggtgatgttgaagcccaggctgttctccagcccggcgccttcgtgggcggcggccatg

SEQ ID NO: 1758 - DNA, 100 bp, Artificial
  Synthetic
aggtttccggctgcgacgccaactccaccagttcagccagctcggggctgggcgcggccgccagcacttcggcattcagcaatgcatccacgcgaggagc

SEQ ID NO: 1759 - DNA, 100 bp, Artificial
  Synthetic
tggcgatgatgttgtgcagggtcatgccgtacttgtccatcaacgcctgcaacttgtccttgaattccagttcctgcttcaggctgctgtcgcttttcag

SEQ ID NO: 1760 - DNA, 100 bp, Artificial
  Synthetic
ctccatgtcgttgaccatcgggatcatcggcgagcagagcacgcccaccgggatgccgttgccgctgagcgtgcggatcgcccgcagtcgcgccgagggc

SEQ ID NO: 1761 - DNA, 100 bp, Artificial
  Synthetic
ttgatcttctcttccagttccaccgggctgtcgatgcgcaggttgtgcacgtcgaggatgatattgccgttgtcggtcagcacgccttcgcggtagaccg

SEQ ID NO: 1762 - DNA, 100 bp, Artificial
  Synthetic
tggaccccggtggtggtctcttcggtgatgccgtggatgcgctcgagcatctgcgggtatttcttgtgcaggatctcggtcaggtcaccgccgtcgtcca

SEQ ID NO: 1763 - DNA, 100 bp, Artificial
  Synthetic
ttctgcagcggggagcaatcccagccgccggtggccgataccttgcagtcgaactgatcggcggcctgtacagtcaatgctgcgaccggctgcagagcca

SEQ ID NO: 1764 - DNA, 100 bp, Artificial
  Synthetic
gccgcttcggcgagggtttcctgcttcaggttgcgcatcgccatggcctgcttgaggcgagcggcgaagctgtcgggcgggatctgggtgctcttgtcca

SEQ ID NO: 1765 - DNA, 100 bp, Artificial
  Synthetic
agtcttccgcggactcgcggatggccagcgccgggcgcgccgccaggaggccgtcgaggcgagccaggaccagttcgttggcgtgatcggcaaggtcagc

SEQ ID NO: 1766 - DNA, 100 bp, Artificial
  Synthetic
gctccaccaccacgttcttcagttcctcgggtaggcgatttaccaggcgatcgacctccgccacacggtcgaggatcacccggctgccacggtggccgcg

SEQ ID NO: 1767 - DNA, 100 bp, Artificial
  Synthetic
cgagaccggccttgtcggcacgccacatctcgccgctgacgccgcccagcgcggcgagcaggatcagtacccagagcggcatttccgtcagtgtctgcgg

SEQ ID NO: 1768 - DNA, 100 bp, Artificial
  Synthetic
gggcctcctccagttgcggacgatagtggcgggcaaccaggccgccgccgagcaaggcgccggccagcaggaccagcaacacggccggcaggagcagagc

SEQ ID NO: 1769 - DNA, 100 bp, Artificial
  Synthetic
ggggtcagcgccaggcggtccagcatcgccggctccaggccattggcgcggccggcggcgaggtcctgctcgttggcgtgggacaactccgcgcgggcgg

SEQ ID NO: 1770 - DNA, 100 bp, Artificial
  Synthetic
gtagtacgacttgatcacggcgatgccgcgacccatcacgtcgcgccaggcgtcgcgggtctcggcgtcgcagtcgcggtcgtgctcggcgaccgccatc

SEQ ID NO: 1771 - DNA, 100 bp, Artificial
  Synthetic
tcgcgcccgcgcagcaggtgccaggcggccgaggcgccgacgaagaaggcggtggcgaggaacgcggcgaccgacatgtgcagcaggcggtaggggaacg

SEQ ID NO: 1772 - DNA, 100 bp, Artificial
  Synthetic
gatcgagcttgtagttcaggccgatctcggtggagttgttccaggaagtggtccgcgccaggtcgccggggccgtagaaatagtcgtccggccagcggtg

SEQ ID NO: 1773 - DNA, 100 bp, Artificial
  Synthetic
cccgagggtgagttgcagcgacaaccggccgggattcggcgaggtcgaggagagcgccgagatcagtaccgcggtgagggcgaaggtgccgccgtggggc

SEQ ID NO: 1774 - DNA, 100 bp, Artificial
  Synthetic
agggtatcctgcttgttcaacagcagggcgaactggttgatgccctggggcgccaggaacaggctcagccaggccaccaggatcgccaccagcagcgccg

SEQ ID NO: 1775 - DNA, 100 bp, Artificial
  Synthetic
cttgcccacgcccatcaggtagcgcggcttgtcggccggcatctgcggcggcaggaaatcgagcacgcggatcatctcttccttcggctcgcccaccgac

SEQ ID NO: 1776 - DNA, 100 bp, Artificial
  Synthetic
gcggccttctggaacttcagctcgacgttgtcggaaacctcgacgacgacgaaatcgtcggcgaccttggtcaccttgccggcgataccgccggaagtga

SEQ ID NO: 1777 - DNA, 100 bp, Artificial
  Synthetic
cgaccgcggctggcggtgaattcttcctggcgtaccgggtcgaggaccacggcgtgctccaggcggcccttgtacttgcaggcgatgctcacggcgaagt

SEQ ID NO: 1778 - DNA, 100 bp, Artificial
  Synthetic
cagcgggatgttcagttcgatgccgcgggtcaggcgagttttcaaactcacgtccttgggcaggacttcggaataaccggggatcagaaggacgtcgtcg

SEQ ID NO: 1779 - DNA, 100 bp, Artificial
  Synthetic
gctgatcgggttgcgctcgccgagctgccagcagcggtcgatcacttcctggcaacgtcgctccatttccgggttgtcgcgctgcaccgaggcgaagtcg

SEQ ID NO: 1780 - DNA, 100 bp, Artificial
  Synthetic
ttgttgacgaagtccttgaccaccggcagggccacgtcggcctcgagcagggccatgcgcacttcgcgcagagtgtccttgatgttgtcctcggtcagct

SEQ ID NO: 1781 - DNA, 100 bp, Artificial
  Synthetic
gtcgacggacagacgcacttcgccaccagtcgcaaccgggttgaagaaaccgatgcgctcgacgaagcgaccatcgcgcgcattgcggctgttggtcacg

SEQ ID NO: 1782 - DNA, 100 bp, Artificial
  Synthetic
ccttcaggccttccagctggtgccagtagtactcaccttcctcgagagagggcaactcgctacgcgggatgcagatctcgtaaccggtgaaggtgcgggc

SEQ ID NO: 1783 - DNA, 100 bp, Artificial
  Synthetic
ctcggcggaatctgcatgacccaatgcaccgggcagcaaccgcgtcactgcatcgaccagcaccatggccggcaactcaccgccggacaggacataatcg

SEQ ID NO: 1784 - DNA, 100 bp, Artificial
  Synthetic
cagcgcagtcccgccgaacagggtgttgtggtgattggtggtgggcgggaataccgccttggtcacacgggtttcggaaagctcggtgcgacgcaggatt

SEQ ID NO: 1785 - DNA, 100 bp, Artificial
  Synthetic
gtaccagcgcggccacggagtcgacgatgatcacgtcgaccgcgttggagcgcaccagcatgtcggtgatttccagggcctgctcgccggtgtccggctg

SEQ ID NO: 1786 - DNA, 100 bp, Artificial
  Synthetic
acggatgcgcaacggcccatggccgctacgggcgcgactggcgatgaagctttcgagatagcgggattcgtcgagcagaccttcctcggccaggcggtcg

SEQ ID NO: 1787 - DNA, 100 bp, Artificial
  Synthetic
acggcgccgatgccgcccttgtccaccggggtgttgcgccaggcgttgtgggtgaagtgggagtcgatggaaacgccgatcacctcgacgttgcgcgcct

SEQ ID NO: 1788 - DNA, 100 bp, Artificial
  Synthetic
cgggtcggtcacgaaggcgatcacggtggtaccgtgcttcatcggcccggcttcgcgggtgacctggccgccgttgttgcggatgtcgtcgcaggcctgg

SEQ ID NO: 1789 - DNA, 100 bp, Artificial
  Synthetic
cacctggggaccgtcgagcaggtagagcgcgtggtagggcttgccggcctggctgccgcgcaggcgatagacctcggtgccggccacgcggtagcggctg

SEQ ID NO: 1790 - DNA, 100 bp, Artificial
  Synthetic
ttcagcgacggcaccgccttctgcagcacctcggccagcgtttccgccagctccagcatcttgtcgtaacgatcggcttcagccttgtccatgaacaaac

SEQ ID NO: 1791 - DNA, 100 bp, Artificial
  Synthetic
atcgcgaatggccttggccacctcggccgccgactcgtgttcgagccagacctcctcctggggcagcaggcgctgatccagcaaccgcagcgtaccgtcc

SEQ ID NO: 1792 - DNA, 100 bp, Artificial
  Synthetic
cgaacatccaggccaccgcgccggcgactatccaggtaagcagggacaaggcttccttgacgaagccgcgactcagactgatcaggctggaaacgacgat

SEQ ID NO: 1793 - DNA, 100 bp, Artificial
  Synthetic
cattggggtcgcggaaaccgacgatgccatggccggtgatcatcgccaccaccgcgtagccgccgacgcaacggtcgtgcacgcaggaaaccgcggcgaa

SEQ ID NO: 1794 - DNA, 100 bp, Artificial
  Synthetic
tcgaggatgccgatgtccttcatgctcatgccgcgcacgcgcaacaggtagtcggcgcgaggattgaagaaggcgggattgatacggcaggattcctcga

SEQ ID NO: 1795 - DNA, 100 bp, Artificial
  Synthetic
tacgctgaacggattaggacgcttgtcctcgacttcgctcgactccggctcgtcttcgacgacgaatccagccgggtgctgacatacttcggggtcatgg

SEQ ID NO: 1796 - DNA, 100 bp, Artificial
  Synthetic
agccgtccggggatacgtggtggcgcaggtggacttcaccggtgctcttttccacggacagagcattggactcgagcgcatcgtgggaacgacgcatgtc

SEQ ID NO: 1797 - DNA, 100 bp, Artificial
  Synthetic
ggaagcggtcgatggtcgcgcgcagggtgctggcatcgcggcgcacgtaccaggccatgtcggcgcgattgtccagcaccaggtggcggtcgacgcgcag

SEQ ID NO: 1798 - DNA, 100 bp, Artificial
  Synthetic
gctcgacttccagcagacgctggatcgaaccggccttctggtcggcatggaccatcaggtggacctgctcgatgcgcgccacggtctgggtcttggcggc

SEQ ID NO: 1799 - DNA, 100 bp, Artificial
  Synthetic
ctccaggtccgggaagtccttcttcaattgcgccgcgacctcgtagcgcagcggcggcacctcgcggttttccttgggcgagagcccttcgaggatggcg

SEQ ID NO: 1800 - DNA, 100 bp, Artificial
  Synthetic
  misc_feature (1)..(18): n is a, c, g, or t
nnnnnnnnnnnnnnnnnnttcgggtagggaaccttttcatccagtttggcggccatggcggtgctggaaagagcggcaacgccggcggcgatcagtagtg

SEQ ID NO: 1801 - DNA, 100 bp, Artificial
  Synthetic
tgctcgcggattttaaagccgatcttctcgtttctcaagtcggacttggcacggaatccgctttccccgaggatccgcaccacctcggcggcgaaatcgg

SEQ ID NO: 1802 - DNA, 100 bp, Artificial
  Synthetic
tagttttacctggtaatccccttcttccgtccctggacgaaacttgatttctttgacctgcgcctgcttctggttcttcttggcgaccgcagcctgcttc

SEQ ID NO: 1803 - DNA, 100 bp, Artificial
  Synthetic
tcttcgaagagttggccccacttgtcgaagacgtccttgtagtagacgctcaccgcatgtccgaagacgatcgggtgggaaatcttcatcatggtcgcct

SEQ ID NO: 1804 - DNA, 100 bp, Artificial
  Synthetic
ccacgtcgccgggcttcttcaccgggctgggcacgccttcgaaccagcgtaccgggcgctggcagacgtagagatcgagttgctggcgcagggccacgtt

SEQ ID NO: 1805 - DNA, 100 bp, Artificial
  Synthetic
tgtcgccggtgaggatgcggatgtagttcttgcgcattttgccggagatgtgcgcggtgacgacgtgcccattttccaactccacacggaacatggtgtt

SEQ ID NO: 1806 - DNA, 100 bp, Artificial
  Synthetic
ctgcggttcgccgggcaacaacgcgcgtgatgaacagaccgcgatacaggtggaatcccgtttgcacgtccaccgtttcggaagcgccttgcagtgaagt

SEQ ID NO: 1807 - DNA, 100 bp, Artificial
  Synthetic
cccaggacaccagcaggtagccgaggcgggtcagggcgttgtagtcacgggcgaacacgacaaagaagatggcgccgccgaagcctcccagcaaggcgtt

SEQ ID NO: 1808 - DNA, 100 bp, Artificial
  Synthetic
ccggtttatgcgtatcaacaatcactacggttgtcttagatgtcatcatatcccaagcatcatctgatgtaataaatcgctctcttaactctggcttttt

SEQ ID NO: 1809 - DNA, 100 bp, Artificial
  Synthetic
cgccaacttcaacttcaactggatatggaatgtacgaatccgcactgcctcccataggtgtaataggtgaaaccaactgttctctattaccacacgtttg

SEQ ID NO: 1810 - DNA, 100 bp, Artificial
  Synthetic
cctcttcagtagcaggcggttgcattgattctttgatatatgcaatttccgcttcgctatccaatcttgggaaaataggtttaggttgcccagtaaccat

SEQ ID NO: 1811 - DNA, 100 bp, Artificial
  Synthetic
ctgtccttcgctaccaattacaatagccaatgacatgtccgcttctagatttctataatctgttgcattattagcttcagtgccagctacccaaaagcca

SEQ ID NO: 1812 - DNA, 100 bp, Artificial
  Synthetic
attttcttttaaatctctccacatttcgcgagatgatattctatatgcacctgatccaaagatagcatgttgctcactcatatcacttgttacaactgta

SEQ ID NO: 1813 - DNA, 100 bp, Artificial
  Synthetic
atactaagaaaaaggctgttgtcgcaaaggcgataacgattgctgttaaaataagtgcttgcgggataggatcaacatagctttttacgttcgcttcata

SEQ ID NO: 1814 - DNA, 100 bp, Artificial
  Synthetic
tacttgatcaacgttacgttttaaaggtgcacgctcttcgatttctttaagaattgtattgaaaccacccacaccttttgcacttaatgtacggattgga

SEQ ID NO: 1815 - DNA, 100 bp, Artificial
  Synthetic
ctacttgtcgaatgtgttcactctcacaatttggacattgattcggtggcgtctcttggtaaccacaatagtgacattttaataagtctgtcgttttatg

SEQ ID NO: 1816 - DNA, 100 bp, Artificial
  Synthetic
atagcctggcgtccatctttttctgaatctacaatgacatgttgtaatgaagcacctaatgctgtttcaattgcctgagttaatttagatggcacatcaa

SEQ ID NO: 1817 - DNA, 100 bp, Artificial
  Synthetic
tgtatttatttctgcttctatactttgaatggtatgttccgactgttctagcgcattttgtttcccgtaattttgaaagtttactgcttgtttttgatgc

SEQ ID NO: 1818 - DNA, 100 bp, Artificial
  Synthetic
gctaatgatttaccactgcctagtgatgcttcaatcattgctttttcactatgcatgagctgatctaatatagtttccgctaaatataattgttgcggtc

SEQ ID NO: 1819 - DNA, 100 bp, Artificial
  Synthetic
tcatttttatcgtaagaaatggcttttttgagataatcttctgaagtcatttcatcttcattaatttcatcgtataagcgaatcgcatcactatagttac

SEQ ID NO: 1820 - DNA, 100 bp, Artificial
  Synthetic
ccaggtttacagaagaattcaagttccatttgttcaaattctcttgttctgaaaatgaagttacctggagtgatttcattacggaatgatttaccaattt

SEQ ID NO: 1821 - DNA, 100 bp, Artificial
  Synthetic
tgcttcattttggcgtggaatatacgcagggtcacctgataataaataacctacaatttggtttacggcattatatcctcgttcatctaatgttcgataa

SEQ ID NO: 1822 - DNA, 100 bp, Artificial
  Synthetic
cagtcattgtccattgcgttaataatcctgtatcccctttcgttaaaggggcatattcatataatggatggtcattaataataattcctgccgcatgtgt

SEQ ID NO: 1823 - DNA, 100 bp, Artificial
  Synthetic
tgcgtaaagctgtagcaagttgctcaaattcatcccagctgttcactgaaactcctgacgcattcggatgaccaccgccaccaaaatcttgcgcaatatc

SEQ ID NO: 1824 - DNA, 100 bp, Artificial
  Synthetic
caatattagctagtggagactcaccagtccctgatggcttgatttcatctgtttcaggtaacaacaatggtagctcttcttcaggaacagttgtcattgt

SEQ ID NO: 1825 - DNA, 100 bp, Artificial
  Synthetic
atgatattaaattaacttgccatgttttaagtcccgattgataccattgccatcttaagcgtaaaccaacatatggaaaaattaatgcactgactccaaa

SEQ ID NO: 1826 - DNA, 100 bp, Artificial
  Synthetic
taagcttgtctagtcgtctgaactacttctctgaaaagtattttctttctattctgttggtgaatatgtttttttgtaataggacgttcttcgctatagt

SEQ ID NO: 1827 - DNA, 100 bp, Artificial
  Synthetic
ttactggtttaaccaatgcactaatcatcgtcaaaatgactagcataataaaacttaaaatagacataataactactggcgtcgctgcggaaatattaaa

SEQ ID NO: 1828 - DNA, 100 bp, Artificial
  Synthetic
atacactttcaatcatatctttagtcgttgttttaccattagaccctgtgacggcaattactttagggtttacatgtctcaagtaagcttgtgccaattg

SEQ ID NO: 1829 - DNA, 100 bp, Artificial
  Synthetic
acgccttttagatcttttttaagcattttaaatcctgtcacttcgacattaccgactaagagtaataagacgataaatacccaccaattctcttttggaa

SEQ ID NO: 1830 - DNA, 100 bp, Artificial
  Synthetic
tagcttcttctaatacagctaatgtaatttttttagtgtcagctctgctaagtgttaacgtgacaggtctaactttgtacttttcaccattaaccttaat

SEQ ID NO: 1831 - DNA, 100 bp, Artificial
  Synthetic
ctgttgttttatcaattccaaggccattatctgttacggcaaagtacatgtagaaaatgagtagggcacgcatgccataataactaaacctttcccagaa

SEQ ID NO: 1832 - DNA, 100 bp, Artificial
  Synthetic
ctgcaccgatattcatatgaccaacttctgagttacccatttgtccttcaggtagtccaacatctaagccactcgcttcgatttgagtcgttggatattt

SEQ ID NO: 1833 - DNA, 100 bp, Artificial
  Synthetic
ttcttcagattcttcatagaaatcattccaagtttctctatcccaaatctcaatacgatttgaaacaccgattactgtacattctttagttaaattagcg

SEQ ID NO: 1834 - DNA, 100 bp, Artificial
  Synthetic
ttgtgtttggtccatacgcatgtctaatgttgcgtcatggtgataactgaatcctcgttctggaatgtcgagttgtgggcttgaaacacccaagtcgtaa

SEQ ID NO: 1835 - DNA, 100 bp, Artificial
  Synthetic
tttgcttcgccattactacgcactacctttacattatcgttctcaaggctcatcccctgtttcttagccttttcgtatatgcgttcataagaagaattct

SEQ ID NO: 1836 - DNA, 100 bp, Artificial
  Synthetic
ccttcgtttatttgcaatgcaccgaaacctaatgttgcagcaacgcctgttactgtagctatgactgccaatacatcaatggcaccacctaaaggtccac

SEQ ID NO: 1837 - DNA, 100 bp, Artificial
  Synthetic
cctttttcttcagaattaggtgatagtatttcccagaataatgaatggttaaaatgaccaccgccattattacggactgacatcctcatcgcttccggta

SEQ ID NO: 1838 - DNA, 100 bp, Artificial
  Synthetic
aacctgttgcatctttattttcaattttagtgattcggatgtaaccaccaccaccacgtttactttcgatttcataaccatgttcattagtgaatcgtgt

SEQ ID NO: 1839 - DNA, 100 bp, Artificial
  Synthetic
tccaccttgaactctgcggacgatatcaatgatgtcatctttaaatgttgcataacaattagcacacccaaatttaccaacatgtgcaatatctttcaaa

SEQ ID NO: 1840 - DNA, 100 bp, Artificial
  Synthetic
cctcttccatagttatcattctacagttttgtaaaatacctagcgagcgaaaaacacggtcttgtgtttctaattgattataagtgtctaacttttgtcg

SEQ ID NO: 1841 - DNA, 100 bp, Artificial
  Synthetic
ccaccttgttcttaaattcaataacgtctttgttttttccatgtaactcaaacttcattaataaagggacattatactcttctgatatcgtgcgacccgc

SEQ ID NO: 1842 - DNA, 100 bp, Artificial
  Synthetic
acgccgcccccaattttacttaattgttttgcagttgaatcaataaagttaattgaatttaagctgtcatccacttctaataagaaacatgacactagct

SEQ ID NO: 1843 - DNA, 100 bp, Artificial
  Synthetic
ccaacttgcaatgtcttttgatactttaaattctgtttcaacccacatttgagatatattttgtctccaaaacatattcgtcatatcttcttgtgtgttc

SEQ ID NO: 1844 - DNA, 100 bp, Artificial
  Synthetic
gcacatctacaagttttctaagtaattcacttctatccatttccataccaactcgaacacttactactaaatctttatattcttcaggattacctaaacc

SEQ ID NO: 1845 - DNA, 100 bp, Artificial
  Synthetic
agttgaacgtttatgaagttcagatgcaagtttcacacgttgagcctcaccacctgataacgttgtagcttgttgacctaatgtgacgtatccaagacca

SEQ ID NO: 1846 - DNA, 100 bp, Artificial
  Synthetic
tgaagtgctgcttgtttctctttttcattggcaagctcttcttgtagttcttgtaatctctgtttgctcgcattgtcagattcatttttaagtgcgcttt

SEQ ID NO: 1847 - DNA, 100 bp, Artificial
  Synthetic
tcttgtccttgtttaagctgttctgcacgacgtacttctagtcttactgaactatagaattttaatgcacgtccacctggtgtagtctctggattaccga

SEQ ID NO: 1848 - DNA, 100 bp, Artificial
  Synthetic
gtctccgtctaatataccagcctcaatcatactgtcgcctacgacgtttaatatgaatatgtcgctattatgtgtcgatgttaagtgttcaggtaatgga

SEQ ID NO: 1849 - DNA, 100 bp, Artificial
  Synthetic
gttcgctattgtttgtagggtctttatgttcgtatgctttatttatcgtattgttcttaatttgatggtcagtcatttcgtacacttgttccgagtgagc

SEQ ID NO: 1850 - DNA, 100 bp, Artificial
  Synthetic
attcaaccgttccaatagttaatggtctttcagaatcagatgtctttccaccttgaacagtcagatgactaattaaaatattgacggcatcttcatcaat

SEQ ID NO: 1851 - DNA, 100 bp, Artificial
  Synthetic
ctgacatcggctgtttaccatcagcgaaatgacttctcaaatcattttcttctctttgttcagttgatgctttaccaaacaaggcataagtcattgcatc

SEQ ID NO: 1852 - DNA, 100 bp, Artificial
  Synthetic
gatctttcaaagtatattgcttatgtacaccgccttcatcactatagccaaaggcaaaatgtatcgttcttgccactttttttcttgctcgaactctgct

SEQ ID NO: 1853 - DNA, 100 bp, Artificial
  Synthetic
gcgaccatcttctttaatttctttaaccattgcacctaaagtatcaacatgagcagtaatacagcgttgtacttcatcatttttgcctggcactgttatt

SEQ ID NO: 1854 - DNA, 100 bp, Artificial
  Synthetic
ttttaaatcactattaccactgccaccattaccgccaccacaagcacctaataatagtgttgcacctaaagctgtagtaccaacaaattgccattttttc

SEQ ID NO: 1855 - DNA, 100 bp, Artificial
  Synthetic
cctcaggtacttctgcagtaccttggttatcgtcaaggattacgaaagcaataccttcgtcgtcgtaatcatatatatctggcgctgctgcaccgcatgc

SEQ ID NO: 1856 - DNA, 100 bp, Artificial
  Synthetic
ttcaagttatgtcgctcaattagtgttttagaaccaacgggttgtccaaaatcaacataatcctcaacaattgcgtttaatatactcaattgcctatctg

SEQ ID NO: 1857 - DNA, 100 bp, Artificial
  Synthetic
gcatcaatacgataaatggttaagcgtactgaatctacaaagccattattataaaatttaacttctacaggttgggcatattgtagcgcctcgtgtagcc

SEQ ID NO: 1858 - DNA, 100 bp, Artificial
  Synthetic
gccacatcacctatttgtggaacaaacgatggtgtgttttcatatactgttgccatgtttttaaaatcgttattgattgcatcttttgcatttccccaca

SEQ ID NO: 1859 - DNA, 100 bp, Artificial
  Synthetic
tccatcgaccattccaatatctacgcaagacagcaacatcagggttacttgtatcataccaaagcatatcattgactggattttctggcggtgtatcact

SEQ ID NO: 1860 - DNA, 100 bp, Artificial
  Synthetic
gccctcgtttcgtgccagcaccaacccaaccttttgcatcaggaaaattagttgctttatatccttcgccaagattggatatcacaaagtcaccgccgac

SEQ ID NO: 1861 - DNA, 100 bp, Artificial
  Synthetic
ttgaatttgattgagggtcccatgtgctattatgacctgcatatagaacatcatttacattcaagtttttaagcatatctttgaactctggagtgccttt

SEQ ID NO: 1862 - DNA, 100 bp, Artificial
  Synthetic
gcgccatttgcgctaaagatgctttatttaagtccgcttcacttgcatgggcttcgtgacctgcatttcctgctacgattcctaaacctactgctaatga

SEQ ID NO: 1863 - DNA, 100 bp, Artificial
  Synthetic
gaccaaatggtccttcagaagattgtaggatagcgcctttagaaggtgtatgatttactgtgaatccagcaccttgtgcagcagcagcccaattattagc

SEQ ID NO: 1864 - DNA, 100 bp, Artificial
  Synthetic
cagagtgtttcatcgatttaatcggttgaggattccattcgtatcctttatctttaccaattgttagaccaccagtagagtgatctgctgttgcaacgac

SEQ ID NO: 1865 - DNA, 100 bp, Artificial
  Synthetic
tgccttcgccagtataagcaggctctaaaacaagattagcctttgcacaataaagccattcaggatgaatgccactattaagtatctcttggaattcttg

SEQ ID NO: 1866 - DNA, 100 bp, Artificial
  Synthetic
atcactaaatgaatcgtcacatttaattgaaacatgctgaaacgttttggttataatttcataaactggtgcgccttcatggtgatactgtcgataaata

SEQ ID NO: 1867 - DNA, 100 bp, Artificial; identical to SEQ ID NO: 995
  Synthetic

SEQ ID NO: 1868 - DNA, 100 bp, Artificial; identical to SEQ ID NO: 996
  Synthetic

SEQ ID NO: 1869 - DNA, 100 bp, Artificial; identical to SEQ ID NO: 997
  Synthetic

SEQ ID NO: 1870 - DNA, 100 bp, Artificial; identical to SEQ ID NO: 999
  Synthetic

SEQ ID NO: 1871 - DNA, 100 bp, Artificial; identical to SEQ ID NO: 1001
  Synthetic

SEQ ID NO: 1872 - DNA, 100 bp, Artificial; identical to SEQ ID NO: 1003
  Synthetic

SEQ ID NO: 1873 - DNA, 100 bp, Artificial; identical to SEQ ID NO: 1004
  Synthetic

SEQ ID NO: 1874 - DNA, 100 bp, Artificial; identical to SEQ ID NO: 1005
  Synthetic

SEQ ID NO: 1875 - DNA, 100 bp, Artificial; identical to SEQ ID NO: 998
  Synthetic

SEQ ID NO: 1876 - DNA, 100 bp, Artificial; identical to SEQ ID NO: 1007
  Synthetic

SEQ ID NO: 1877 - DNA, 50 bp, Artificial
  Synthetic
gaagtgttaattcgaaccgactgataaacattcccactccatcccagctg

SEQ ID NO: 1878 - DNA, 50 bp, Artificial
  Synthetic
gttcatatgatgtataaccatcatgcgacagcctctcctgaaaaattgca

SEQ ID NO: 1879 - DNA, 50 bp, Artificial
  Synthetic
cggtcgaggtatagccggtgacccggaaatcggcttttaacgctgacagt

SEQ ID NO: 1880 - DNA, 50 bp, Artificial
  Synthetic
aagacttccaaatcccattgcaactgctgtaactcttttaaggtctcctt

SEQ ID NO: 1881 - DNA, 50 bp, Artificial
  Synthetic
cagcaacaaattggcggcggcgttatcactgtattgcacggcggccgcgg

SEQ ID NO: 1882 - DNA, 50 bp, Artificial
  Synthetic
cgaaacccggcatgtcgagataggaagtgtgctgccagacattcggtgcg

SEQ ID NO: 1883 - DNA, 50 bp, Artificial
  Synthetic
ctgatttgctccgtggccgaaattcgaataccaccgtcgagccagaaact

SEQ ID NO: 1884 - DNA, 50 bp, Artificial
  Synthetic
tcgtcccattgacgtgcttttccgcaatcggattatagttaacaaggtca

SEQ ID NO: 1885 - DNA, 50 bp, Artificial
  Synthetic
gataggcgtcagtgtttacaagaaccaccaaaccgtgtttagaaacaaca

SEQ ID NO: 1886 - DNA, 50 bp, Artificial
  Synthetic
gaccgtccggtttaacaaaacaaccaccgaataaaattttcttttcaggt

SEQ ID NO: 1887 - DNA, 50 bp, Artificial
  Synthetic
taagccactctattccccctgtgctgtcgctatggaaatgtgaggaaata

SEQ ID NO: 1888 - DNA, 50 bp, Artificial
  Synthetic
cttttagccccttaacagcctgctcccaagtgcgcttcaatagtgatgcg

SEQ ID NO: 1889 - DNA, 50 bp, Artificial
  Synthetic
taagccactctattccgcccgtgctgtcgctatgaaaatgagaggaaata

SEQ ID NO: 1890 - DNA, 50 bp, Artificial
  Synthetic
tctttttcttaactagccaatagctaactccgctaaatgaatttttagct

SEQ ID NO: 1891 - DNA, 50 bp, Artificial
  Synthetic
gcgcacggccggcacgtataccacaagattgtcgcccgaatgcgcagcac

SEQ ID NO: 1892 - DNA, 50 bp, Artificial
  Synthetic
cgttacgggaagtccaatttgcttctcaatctccgcgagaagtgccgctg

SEQ ID NO: 1893 - DNA, 50 bp, Artificial
  Synthetic
tgaaacttgtattgcccctcttaaggtcaagtctctttcccattgcttca

SEQ ID NO: 1894 - DNA, 50 bp, Artificial
  Synthetic
gctcagaattttaacatacgcactggcgcgctgttcctgcatccaggttg

SEQ ID NO: 1895 - DNA, 50 bp, Artificial
  Synthetic
aacgcagacgcccagctcacgttcgtcttctgttaataccgaataactgg

SEQ ID NO: 1896 - DNA, 50 bp, Artificial
  Synthetic
ccgatcgcatccagcattttgtggcgaacaaattcgtcttcaaagcgcag

SEQ ID NO: 1897 - DNA, 50 bp, Artificial
  Synthetic
ggctcgcatcgtcctgtttggactgttgtgcacttctgcgccccatgtac

SEQ ID NO: 1898 - DNA, 50 bp, Artificial
  Synthetic
taccgcctttacgctgcaggccgctgaacagttttttaccggtggcatcg

SEQ ID NO: 1899 - DNA, 50 bp, Artificial
  Synthetic
cgagatgtaaaggggtatcaaacgtatgggcggcatacttctccagcata

SEQ ID NO: 1900 - DNA, 50 bp, Artificial
  Synthetic
ggatcacccggccatcgcggatcagtttatccataattttggtcgctaac

SEQ ID NO: 1901 - DNA, 50 bp, Artificial
  Synthetic
gcgcattgcctttcggacgcagctgggcaaggaagacgtcatggaagcgg

SEQ ID NO: 1902 - DNA, 50 bp, Artificial
  Synthetic
gacagcgccatcgctttatgctgcgcttccatcttatcgatctgcgcttc

SEQ ID NO: 1903 - DNA, 50 bp, Artificial
  Synthetic
attcctgacgcggcgttttcacggtttctttaatcggtgtactggagacc

SEQ ID NO: 1904 - DNA, 50 bp, Artificial
  Synthetic
gaccggtcatgctgctggattggatccccgtgaggcttaacaccagcccg

SEQ ID NO: 1905 - DNA, 50 bp, Artificial
  Synthetic
aacggttatcacgccattcatagtgacgacgccagtaatcacggtcgcgc

SEQ ID NO: 1906 - DNA, 50 bp, Artificial
  Synthetic
cagagcactgcgccaacgaagatgcttaggattgcgccatgcgcaaagaa

SEQ ID NO: 1907 - DNA, 50 bp, Artificial
  Synthetic
cgacggattgataccgcgcttacgcagcaggtcgtaagagtagtcatccg

SEQ ID NO: 1908 - DNA, 50 bp, Artificial
  Synthetic
cgcgccttctcagtcggcgaccagcgagcatcgtactgcttggaaataag

SEQ ID NO: 1909 - DNA, 50 bp, Artificial
  Synthetic
ggcgcctgcgcacgcatttcacggcaaagctcaaacaagttatcacgcag

SEQ ID NO: 1910 - DNA, 50 bp, Artificial
  Synthetic
aatgaacataaagtgcggtgctgactccgcgggcggtgaggtattggcac

SEQ ID NO: 1911 - DNA, 50 bp, Artificial
  Synthetic
cagtttgttgttggtgttagcggaagtaatgctgtagccggtcgcgccag

SEQ ID NO: 1912 - DNA, 50 bp, Artificial; identical to SEQ ID NO: 1894
  Synthetic

SEQ ID NO: 1913 - DNA, 50 bp, Artificial; identical to SEQ ID NO: 1895
  Synthetic

SEQ ID NO: 1914 - DNA, 50 bp, Artificial; identical to SEQ ID NO: 1896
  Synthetic

SEQ ID NO: 1915 - DNA, 50 bp, Artificial
  Synthetic
ctcagcgcggacgcgctccagatcttccggggtatccacgccggtgccgg

SEQ ID NO: 1916 - DNA, 50 bp, Artificial
  Synthetic
gacgctggcgcaccaaatcgttgatcgcgttattggcgcgctggctgatg

SEQ ID NO: 1917 - DNA, 50 bp, Artificial
  Synthetic
cgtgattatccagctcgtcgagaccgatatgacggcccgcgcgcagggcg

SEQ ID NO: 1918 - DNA, 50 bp, Artificial; identical to SEQ ID NO: 1897
  Synthetic

SEQ ID NO: 1919 - DNA, 50 bp, Artificial
  Synthetic
ctttccgcctgcgaaccgcttgccgacatgcgcggtaccagaacatacct

SEQ ID NO: 1920 - DNA, 50 bp, Artificial
  Synthetic
cgtctcgccgtggccgcgccaggcccagaaattctgcgtatcgccgaaat

SEQ ID NO: 1921 - DNA, 50 bp, Artificial; identical to SEQ ID NO: 1898
  Synthetic

SEQ ID NO: 1922 - DNA, 50 bp, Artificial
  Synthetic
tcacctgccccggatgattcgggcggataaagcccgtcgccagcagcgtc

SEQ ID NO: 1923 - DNA, 50 bp, Artificial
  Synthetic
gcgatttcaccgcctgcggatcggaaaccagcagcacgaccatgtcgtta

SEQ ID NO: 1924 - DNA, 50 bp, Artificial; identical to SEQ ID NO: 1899
  Synthetic

SEQ ID NO: 1925 - DNA, 50 bp, Artificial
  Synthetic
tctggatggtgttcatcagcgaataccagtccttctcgatacgttgcata

SEQ ID NO: 1926 - DNA, 50 bp, Artificial; identical to SEQ ID NO: 1900
  Synthetic

SEQ ID NO: 1927 - DNA, 50 bp, Artificial
  Synthetic
gcgcgccaggcggtagatgagcttcatgtccgctttaatgatcggcaaaa

SEQ ID NO: 1928 - DNA, 50 bp, Artificial
  Synthetic
tcgaattatagggcaggacgtacatgaccggacgcgaggtatcgagtcct

SEQ ID NO: 1929 - DNA, 50 bp, Artificial
  Synthetic
aagttgtccgcttcgatccagccaaggttgccgcgcaccacaaagcggtg

SEQ ID NO: 1930 - DNA, 50 bp, Artificial
  Synthetic
caagttgcttacgccaaacgtctcgccgattttacccacaacctgaccac

SEQ ID NO: 1931 - DNA, 50 bp, Artificial
  Synthetic
tgcggtgaccccaccacagctgacgggagatacaccagtcctgaatatcg

SEQ ID NO: 1932 - DNA, 50 bp, Artificial; identical to SEQ ID NO: 1901
  Synthetic

SEQ ID NO: 1933 - DNA, 50 bp, Artificial
  Synthetic
cagcacgataaagaagaacacctggaacggctccatgcccagcagcgtgc

SEQ ID NO: 1934 - DNA, 50 bp, Artificial
  Synthetic
ctgacccaggtcccgccgagcatattaacgaaagtaaagatccacacgat

SEQ ID NO: 1935 - DNA, 50 bp, Artificial
  Synthetic
gacgacgaccgctttatccttcaggtccgggaaatctttgatcggaccgc

SEQ ID NO: 1936 - DNA, 50 bp, Artificial
  Synthetic
gtggattttaccgtaggaacgaattttttcttcatagcgacggcattccg

SEQ ID NO: 1937 - DNA, 50 bp, Artificial
  Synthetic
gatctttggttttgatattggctttcgcgtagtcaacggagccggtgccg

SEQ ID NO: 1938 - DNA, 50 bp, Artificial; identical to SEQ ID NO: 1909
  Synthetic

SEQ ID NO: 1939 - DNA, 50 bp, Artificial
  Synthetic
attgccgtcagctttctgatcgacgctacggttagagctggagtagcctg

SEQ ID NO: 1940 - DNA, 50 bp, Artificial
  Synthetic
tactcttccggtcggtcgattttgccttccatgttctcatgcggaaacag

SEQ ID NO: 1941 - DNA, 50 bp, Artificial
  Synthetic
gatggcgtgtagcgtttccgcatggtggcgcaaaacgaggaagacatcgc

SEQ ID NO: 1942 - DNA, 50 bp, Artificial
  Synthetic
ccgcttcaacatcgatactctgcggatcgcaggtgaccaccccgaagctg

SEQ ID NO: 1943 - DNA, 50 bp, Artificial
  Synthetic
cggctgggtaaactggtctttggtacgatcgtaagcggtacagcccgcca

SEQ ID NO: 1944 - DNA, 50 bp, Artificial
  Synthetic
ctcgtccggcgacagcagggtggtcatttcataggaaaaatcatagatcg

SEQ ID NO: 1945 - DNA, 50 bp, Artificial
  Synthetic
cccagtgcgaattgtcagcctgcacgtccacccgcaaattgctgtacacc

SEQ ID NO: 1946 - DNA, 50 bp, Artificial; identical to SEQ ID NO: 1906
  Synthetic

SEQ ID NO: 1947 - DNA, 50 bp, Artificial
  Synthetic
tcggccccaccccctcgatagtctcaagcgagctggtgctcttcactttc

SEQ ID NO: 1948 - DNA, 50 bp, Artificial
  Synthetic
gcccgccacggagcgcgcgattttgcgcgtcgcttcaagaccaccgatcc

SEQ ID NO: 1949 - DNA, 50 bp, Artificial
  Synthetic
ggtgttggcgatggagtcttcgatatgcagaccgaaataggtccccataa

SEQ ID NO: 1950 - DNA, 50 bp, Artificial
  Synthetic
aacaaaatcgatatccagctgcacaccgccgtcaacgtcagtgaaggttg

SEQ ID NO: 1951 - DNA, 50 bp, Artificial
  Synthetic
cggtaggtagggaggccggcatcgctgaataaacgtcgcgcttcctgcga

SEQ ID NO: 1952 - DNA, 50 bp, Artificial
  Synthetic
ttgcatcagcgataaaaccctgcggctccttagacagaatgatgtgcggg

SEQ ID NO: 1953 - DNA, 50 bp, Artificial
  Synthetic
cgcgccgtcaaacttcagcgtgacaaacatgtacgagccaagcgtggtga

SEQ ID NO: 1954 - DNA, 50 bp, Artificial
  Synthetic
accgcccagggcataaatataacggcccaggcgagtatggtgcagcatgt

SEQ ID NO: 1955 - DNA, 50 bp, Artificial
  Synthetic
atcactgttaagaatggcatcgacaatcgcctggtggagatcgagcttca

SEQ ID NO: 1956 - DNA, 50 bp, Artificial
  Synthetic
ccagcttgtccgggtgttctacggaaactttaatgccggtgtctttttca

SEQ ID NO: 1957 - DNA, 50 bp, Artificial
  Synthetic
ggccagagagagcttaccgaagccaaggtcaacgttttccagacctgcac

SEQ ID NO: 1958 - DNA, 50 bp, Artificial
  Synthetic
ggatctgcaccagggtgccttccatcatattcatcgccaccaggccgcgg

SEQ ID NO: 1959 - DNA, 50 bp, Artificial
  Synthetic
accgtggccattttctgcaggccagccgtctggtagcgctggatctcctg

SEQ ID NO: 1960 - DNA, 50 bp, Artificial
  Synthetic
acgggcgcgctcggtatagttggcggtctcttccatcaaatgttgcttga

SEQ ID NO: 1961 - DNA, 50 bp, Artificial
  Synthetic
cgacgtcgcgatagtccagcagcttatgctcggcgaggatcacaatgtgc

SEQ ID NO: 1962 - DNA, 50 bp, Artificial
  Synthetic
cccagcgagagcatggacaggtcgtgggtataaaacagcgcgataatcac

SEQ ID NO: 1963 - DNA, 50 bp, Artificial
  Synthetic
cactcgccgatcttcaccgaaaatagcccttcctgctgcgtcgagtcgat

SEQ ID NO: 1964 - DNA, 50 bp, Artificial
  Synthetic
tgtccatccacagcttgagcagcggcggtacgctataccactgcatagga

SEQ ID NO: 1965 - DNA, 50 bp, Artificial
  Synthetic
agtacgctacggcatcgtcaaaatctttgcctttcggcgcatgcagacgg

SEQ ID NO: 1966 - DNA, 50 bp, Artificial
  Synthetic
tttaccgtcaatgcggctgcggattttctggtcgaggtagacgccatagg

SEQ ID NO: 1967 - DNA, 50 bp, Artificial
  Synthetic
gtctggataaagttttcgtagttttccacgttgaggccgctacggcccag

SEQ ID NO: 1968 - DNA, 50 bp, Artificial
  Synthetic
tttgcagcgtaaaccccagaatatcgcaatagaacgctttactgcgggcg

SEQ ID NO: 1969 - DNA, 50 bp, Artificial
  Synthetic
caactgcttttccgtcttcacattgtccagacggtcgctatagcttttac

SEQ ID NO: 1970 - DNA, 50 bp, Artificial
  Synthetic
gaggcggcatcaggctgcggcttctcttcgatgatattgactatctcctg

SEQ ID NO: 1971 - DNA, 50 bp, Artificial
  Synthetic
tgcgaaagcgtttaatcaggcttcccagctcgcgccgacgctttttatta

SEQ ID NO: 1972 - DNA, 50 bp, Artificial
  Synthetic
gctcgcccgcctgcagccctttctcgaccgcaaactgctgcccctgctgc

SEQ ID NO: 1973 - DNA, 50 bp, Artificial; identical to SEQ ID NO: 1911
  Synthetic

SEQ ID NO: 1974 - DNA, 50 bp, Artificial
  Synthetic
tcagcatcggcccaaggatatagccgaggaacccggtgaaggcgaaggcg

SEQ ID NO: 1975 - DNA, 50 bp, Artificial; identical to SEQ ID NO: 1903
  Synthetic

SEQ ID NO: 1976 - DNA, 50 bp, Artificial
  Synthetic
cgtaatgggcagggtctgcgggtcgtcatcgatatgctcagacagcggct

SEQ ID NO: 1977 - DNA, 50 bp, Artificial
  Synthetic
cgatcatgctgtcgccagcggctttgacaaaataggtcgcgctgggatgc

SEQ ID NO: 1978 - DNA, 50 bp, Artificial
  Synthetic
ggcgcggatttcgcggccaaaatcggtcagatctctgcaatgacgcacac

SEQ ID NO: 1979 - DNA, 50 bp, Artificial; identical to SEQ ID NO: 1902
  Synthetic

SEQ ID NO: 1980 - DNA, 50 bp, Artificial
  Synthetic
ctttgccgttgccggtaaagaccatcacaatgccgcgctcgtcctgggcc

SEQ ID NO: 1981 - DNA, 50 bp, Artificial
  Synthetic
tggcgttgaccgcctggccgttgacgctggtcagcacgaagcgatgatgc

SEQ ID NO: 1982 - DNA, 50 bp, Artificial
  Synthetic
gctcattgctctgcttgagcttctgcgcaatctccgtcagcttgcggctg

SEQ ID NO: 1983 - DNA, 50 bp, Artificial
  Synthetic
atacatacttcgcaacgaatggagcagagcacgcgaaactgggtcgcggt

SEQ ID NO: 1984 - DNA, 50 bp, Artificial
  Synthetic
ggagggagcggtttgccgcgggcgacatttttggcgatacccggcggcag

SEQ ID NO: 1985 - DNA, 50 bp, Artificial; identical to SEQ ID NO: 1910
  Synthetic

SEQ ID NO: 1986 - DNA, 50 bp, Artificial; identical to SEQ ID NO: 1904
  Synthetic

SEQ ID NO: 1987 - DNA, 50 bp, Artificial
  Synthetic
ggtgcgcaccaccgggacgccggccaggcgcgccgcctcttcattgccgc

SEQ ID NO: 1988 - DNA, 50 bp, Artificial; identical to SEQ ID NO: 1905
  Synthetic

SEQ ID NO: 1989 - DNA, 50 bp, Artificial
  Synthetic
gcggctgagggtcatcaccaggccatgatgcagccccacgttacgggtga

SEQ ID NO: 1990 - DNA, 50 bp, Artificial
  Synthetic
gggtatctttcagcgcgaagcgcgcgcacaggtcggcacgggtggcgccg

SEQ ID NO: 1991 - DNA, 50 bp, Artificial
  Synthetic
  misc_feature (1)..(30): n is a, c, g, or t
nnnnnnnnnnnnnnnnnnnnnnnnnnnnnnggatgaataactaacgctgt

SEQ ID NO: 1992 - DNA, 50 bp, Artificial
  Synthetic
cggcggtaggggcgaggatcagcgtcgccagtccttcgaaggtgatggcg

SEQ ID NO: 1993 - DNA, 50 bp, Artificial; identical to SEQ ID NO: 1907
  Synthetic

SEQ ID NO: 1994 - DNA, 50 bp, Artificial
  Synthetic
tcataacgcccctgatcgccgcggatgcgcagccccatatcgtgacgacg

SEQ ID NO: 1995 - DNA, 50 bp, Artificial
  Synthetic
cagttcaccacgaaccactttgcctgagggcagctcgctaaagtcagcgg

SEQ ID NO: 1996 - DNA, 50 bp, Artificial
  Synthetic
tgccttccgcctcggcggcttcggtgagcatgcgcgcggaatcgtcgctg

SEQ ID NO: 1997 - DNA, 50 bp, Artificial
  Synthetic
tcagattgtcgttatcgacatcgatcatcaccggcgtggcgcccagcagg

SEQ ID NO: 1998 - DNA, 50 bp, Artificial
  Synthetic
atactgggcgattttgaaatagataattagcccggtgccatcaatcagcg

SEQ ID NO: 1999 - DNA, 50 bp, Artificial
  Synthetic
gccggttttatcctgaccatccacatcaatgccgttatccagcatggctg

SEQ ID NO: 2000 - DNA, 50 bp, Artificial; identical to SEQ ID NO: 1908
  Synthetic

SEQ ID NO: 2001 - DNA, 50 bp, Artificial
  Synthetic
gtcattatcgccgccagcgttttttcccagctaaacgacagcagcatgac

SEQ ID NO: 2002 - DNA, 50 bp, Artificial
  Synthetic
cctttaacagccatgagaggacaaacgccaccgccataatgccggccgcc

SEQ ID NO: 2003 - DNA, 50 bp, Artificial
  Synthetic
ctggcgcagaatcggcatctcgccgatgatctcctgcatccacagcggcg

SEQ ID NO: 2004 - DNA, 50 bp, Artificial
  Synthetic
tgacgccgatcgccgcgtacattttatcgccgctggctttgacgatagcg

SEQ ID NO: 2005 - DNA, 50 bp, Artificial
  Synthetic
ttcttatcttcgcgatagatacgtaccgcttcgtcgagatccatacgcgc

SEQ ID NO: 2006 - DNA, 50 bp, Artificial
  Synthetic
cttcagcatgttttcggtggtacgaataacgataggcacctgcagcagcg

SEQ ID NO: 2007 - DNA, 50 bp, Artificial
  Synthetic
aatgctcggccaggaagagatgatcagggaaacgatgatgccgcccagca

SEQ ID NO: 2008 - DNA, 50 bp, Artificial
  Synthetic
catcagccagcggagcatcagaagcaccgaaatcaacggtgttggcaata

SEQ ID NO: 2009 - DNA, 50 bp, Artificial
  Synthetic
ggaactcaatcacgtcatcttcaatgccaatctgctccacatcggtggcg

SEQ ID NO: 2010 - DNA, 50 bp, Artificial
  Synthetic
ctgaataaagacctcttccacccagcgtttgccacagaagacgccatctt

SEQ ID NO: 2011 - DNA, 50 bp, Artificial
  Synthetic
gcatcggattgacgaaaatactgaccaccaccacgtccgcactggctttg

SEQ ID NO: 2012 - DNA, 50 bp, Artificial
  Synthetic
tagcgatcagctcgcgaattttgcgctgacagttttcgataaaggtggcg

SEQ ID NO: 2013 - DNA, 50 bp, Artificial
  Synthetic
gggtcgataaaattggcgaagccgcgcttcaataccaccggccgtttttg

SEQ ID NO: 2014 - DNA, 50 bp, Artificial
  Synthetic
aaaacgacgcgtttgcccgtcggcaatgcccgcgtcttcggcaaaagcgg

SEQ ID NO: 2015 - DNA, 50 bp, Artificial
  Synthetic
ccggcgtgcttgcgcagcagcggcgaacgctgggtcagcagcaggccggg

SEQ ID NO: 2016 - DNA, 50 bp, Artificial
  Synthetic
gctccagaccgcggcgccagcgttccgcagtggtattctgatgacagcgc

SEQ ID NO: 2017 - DNA, 50 bp, Artificial
  Synthetic
tgccgggtatcagattaagcatagcaaatgcccctttgaggcggtgggcg

SEQ ID NO: 2018 - DNA, 50 bp, Artificial
  Synthetic
gttgctcgaacagcatgcccgactcgaaggcgttaaggctcagcatccgt

SEQ ID NO: 2019 - DNA, 50 bp, Artificial
  Synthetic
aacagcacgatcgctttgatgacgcagagaataaatgccaccagcagcga

SEQ ID NO: 2020 - DNA, 50 bp, Artificial
  Synthetic
tggtcgctaactggaacgggatcgcaaagccaatgccttccggcgtttcg

SEQ ID NO: 2021 - DNA, 50 bp, Artificial
  Synthetic
agtttgccgagatcgcgcaggtgcacgtgcccggggacaaactgggtaaa

SEQ ID NO: 2022 - DNA, 50 bp, Artificial
  Synthetic
cgcgtaaagccgccgtcgccgcacagcttgccgctgttcatcgcagactg

SEQ ID NO: 2023 - DNA, 50 bp, Artificial
  Synthetic
agatcacgaggaaaaacaccacgcgggagccgaacgaatccagcccctcg

SEQ ID NO: 2024 - DNA, 50 bp, Artificial
  Synthetic
catatacagcgcgtgcggatacaggcgccggcagtcgcgcataaagatct

SEQ ID NO: 2025 - DNA, 50 bp, Artificial
  Synthetic
tgccaagaaattgttcgagaacagcctggcgacgcaggttagaactgata

SEQ ID NO: 2026 - DNA, 50 bp, Artificial
  Synthetic
cgcgccaacgttagtgtcatagaggaacttacgccgcgagctgctggccg

SEQ ID NO: 2027 - DNA, 50 bp, Artificial
  Synthetic
aaagccgaagaccaggaacagggccacggcgctgaacacttcgcgcaggc

SEQ ID NO: 2028 - DNA, 50 bp, Artificial
  Synthetic
ccgtcggccaccatcactttgaaacgggtggtcgccccgttgtccagggt

SEQ ID NO: 2029 - DNA, 50 bp, Artificial
  Synthetic
cgttgatgcggaagctgttatccatatggggatcgttgatgagccctttc

SEQ ID NO: 2030 - DNA, 50 bp, Artificial
  Synthetic
actggctgtgcgcggtttgcgccacgctcattttctgttccagcgacagc

SEQ ID NO: 2031 - DNA, 50 bp, Artificial
  Synthetic
tcagctttctgatcgacgctacggttagagctggagtagcctgcagacag

SEQ ID NO: 2032 - DNA, 50 bp, Artificial
  Synthetic
ggtccagacgtgctcgccgaccatttttccatagaagtccagtttgttgc

SEQ ID NO: 2033 - DNA, 50 bp, Artificial
  Synthetic
ttccactggaatacgatagtcatcgttcaaacgctgcttcagccccggaa

SEQ ID NO: 2034 - DNA, 50 bp, Artificial
  Synthetic
cccgccagaatggcatggataacgtacaggatcggcgccacgaacatgaa

SEQ ID NO: 2035 - DNA, 50 bp, Artificial
  Synthetic
ccagctgcccatgatgaagcccatcagacgctgaggaaccagctgagcga

SEQ ID NO: 2036 - DNA, 50 bp, Artificial
  Synthetic
gacgtgcagcacgcttggttttggtaccggctttaacggcagccatggtg

SEQ ID NO: 2037 - DNA, 50 bp, Artificial
  Synthetic
tcaccagcgcggcgaggatcaagccagccggcaggaaaatgcgcggattc

SEQ ID NO: 2038 - DNA, 50 bp, Artificial
  Synthetic
gcgatcagcaccagcaggtagaactcttctttgttgtccttgtaaccctc

SEQ ID NO: 2039 - DNA, 50 bp, Artificial
  Synthetic
ctggcgcaggaagctgccaaacagcgggtgatagcggaaccattcgccgg

SEQ ID NO: 2040 - DNA, 50 bp, Artificial
  Synthetic
gtcagcaggcgaataccgcgagaagcgccggagacgatctcgatcgcgcc

SEQ ID NO: 2041 - DNA, 50 bp, Artificial
  Synthetic
cccgcgccaggcgtttttcagcatcgccagcgacacgccgcgcagcgtca

SEQ ID NO: 2042 - DNA, 50 bp, Artificial
  Synthetic
tacggcatcaaagaattcacgcgcctcttcaatggtcatatccagcactt

SEQ ID NO: 2043 - DNA, 50 bp, Artificial
  Synthetic
atactcaccagcgacttccgccagtttgccgaacagcacaacgcggtgcc

SEQ ID NO: 2044 - DNA, 50 bp, Artificial
  Synthetic
ccattgacccggcgcagggtacgcaggtggatcacgttctcgccctcatt

SEQ ID NO: 2045 - DNA, 50 bp, Artificial
  Synthetic
agccttgtttgaccacgttgatcatccaggggacgccaaagcggtcgacg

SEQ ID NO: 2046 - DNA, 50 bp, Artificial
  Synthetic
tcgaagagctgcctttaaccttcagatctttcacgacggtaacgctgtcg

SEQ ID NO: 2047 - DNA, 50 bp, Artificial
  Synthetic
ccagcggcgggtacggcgcttcgaaatcgatcttgtcgtacgggttgacc

SEQ ID NO: 2048 - DNA, 50 bp, Artificial
  Synthetic
tattgtagcaaagtcatcgttgacgaagggcaggatcccttccgccaccg

SEQ ID NO: 2049 - DNA, 50 bp, Artificial
  Synthetic
gcgcttacccaattcgccgcgataatacagctggacagcaataaaccgga

SEQ ID NO: 2050 - DNA, 50 bp, Artificial
  Synthetic
tccacgcccaccgatttacgctgccgatcgttatgaatttcccgctcatc

SEQ ID NO: 2051 - DNA, 50 bp, Artificial
  Synthetic
tggcgcgcttggtcataaagttatcggtctgggcagaggaatcgccgccg

SEQ ID NO: 2052 - DNA, 50 bp, Artificial
  Synthetic
ccctgcatttcgatcacctcttccaccgccatcggtgaaatacggcgcat

SEQ ID NO: 2053 - DNA, 50 bp, Artificial
  Synthetic
ccagcacgtcaaactcgccaagacgcaggtcgcggatgatttccatgcgc

SEQ ID NO: 2054 - DNA, 50 bp, Artificial
  Synthetic
gttggtgttagcggaagtaatgctgtagccggtcgcgccagcggcttcgg

SEQ ID NO: 2055 - DNA, 50 bp, Artificial
  Synthetic
acttgtagataacggcggtaccgtgaagggtattcggaccggttaccgaa

SEQ ID NO: 2056 - DNA, 50 bp, Artificial
  Synthetic
tctttttcatgcttgctggcgtcggtgttgatcgccggcagcgtcatcat

SEQ ID NO: 2057 - DNA, 50 bp, Artificial
  Synthetic
gctttgacaaaataggtcgcgctgggatgctgcaccagcagctcgttgag

SEQ ID NO: 2058 - DNA, 50 bp, Artificial
  Synthetic
cgtggcgcggatttcgcggccaaaatcggtcagatctctgcaatgacgca

SEQ ID NO: 2059 - DNA, 50 bp, Artificial
  Synthetic
ggccggtcgtccgcaagtagccaggcgcagagctgcttgttacgccgtag

SEQ ID NO: 2060 - DNA, 50 bp, Artificial
  Synthetic
cagctgtcaggcactttcagatagaacagcgtcagcgcgccaaagacggc

SEQ ID NO: 2061 - DNA, 50 bp, Artificial
  Synthetic
gctcatgcagggtgcccatcatccgcgggtggttggtgcccggattatgg

SEQ ID NO: 2062 - DNA, 50 bp, Artificial
  Synthetic
tcgttctcgaaaatttccaccccctgataccccgccgccgcaatagcgtg

SEQ ID NO: 2063 - DNA, 50 bp, Artificial
  Synthetic
ttcgccagcatcgtgcccatttccggcaggccggtcgaggtcattatcat

SEQ ID NO: 2064 - DNA, 50 bp, Artificial
  Synthetic
ccagatcgagcattttgtcgtaagcgtcggcctcttttttgctggcaaaa

SEQ ID NO: 2065 - DNA, 50 bp, Artificial
  Synthetic
tgcaaccacgtccttacagcggcggcatccgccaaccgccaatgcgcctg

SEQ ID NO: 2066 - DNA, 50 bp, Artificial
  Synthetic
cggacgggaagcgcgtcggatcgtagttagtgttggcagagatcgactgg

SEQ ID NO: 2067 - DNA, 50 bp, Artificial
  Synthetic
ctgcgccgccagcacgaacaggtcatagcactcctgcttgcactcttcgg

SEQ ID NO: 2068 - DNA, 50 bp, Artificial
  Synthetic
tcacttcgccatttttgaacatcataatggtcgggatgctgcggatacga

SEQ ID NO: 2069 - DNA, 50 bp, Artificial; identical to SEQ ID NO: 1990
  Synthetic

SEQ ID NO: 2070 - DNA, 50 bp, Artificial
  Synthetic
tgctgttgcgtcataccgacacgaatttttgctacatcgtttggtgccag

SEQ ID NO: 2071 - DNA, 50 bp, Artificial
  Synthetic
ctggatatcttccatcaggtagccgcggtaaagcaggaatcgctgaactt

SEQ ID NO: 2072 - DNA, 50 bp, Artificial
  Synthetic
ccaccggtagtggtttccgggttaccgaacatcacgccaattttcatacg

SEQ ID NO: 2073 - DNA, 50 bp, Artificial
  Synthetic
tcctgggcgcagatgacgccgatgcagccggtggactggctgagcaacga

SEQ ID NO: 2074 - DNA, 50 bp, Artificial
  Synthetic
gcgcccagcagcgtttcgcccggcgcgttaaagcggtttttgccgctctg

SEQ ID NO: 2075 - DNA, 50 bp, Artificial; identical to SEQ ID NO: 2004
  Synthetic

SEQ ID NO: 2076 - DNA, 50 bp, Artificial; identical to SEQ ID NO: 2008
  Synthetic

SEQ ID NO: 2077 - DNA, 50 bp, Artificial
  Synthetic
gatgatctcctgttcaaggacatcgagatattgatcggccttatgctgct

SEQ ID NO: 2078 - DNA, 50 bp, Artificial
  Synthetic
gcgccagcgctaaaaacgatggtgaccatagcttcagcctgcgcttcggt

SEQ ID NO: 2079 - DNA, 50 bp, Artificial
  Synthetic
atcgaggcatagcgattggagacaaacgcgtcgcgcggatcgtcgcgctc

SEQ ID NO: 2080 - DNA, 50 bp, Artificial
  Synthetic
tgtcggtcacgttacgcagaccgaaagagatggtgatgcagtcaaaggta

SEQ ID NO: 2081 - DNA, 50 bp, Artificial
  Synthetic
gcgcgaatactcttcaccaggttgctgccgctaaactgcagcggtagtcc

SEQ ID NO: 2082 - DNA, 50 bp, Artificial
  Synthetic
cagccaaggttgccgcgcaccacaaagcggtggcggtcatagagggtacg

SEQ ID NO: 2083 - DNA, 50 bp, Artificial
  Synthetic
ccgcgcgtggtcaccgcatcgggaaaataaccgtattctttctccgccaa

SEQ ID NO: 2084 - DNA, 50 bp, Artificial
  Synthetic
taccatagtgccgttaggtgccagacttggcgtttcgtctaaaaacgttg

SEQ ID NO: 2085 - DNA, 50 bp, Artificial
  Synthetic
gcagctcagcgcggacgcgctccagatcttccggggtatccacgccggtg

SEQ ID NO: 2086 - DNA, 50 bp, Artificial
  Synthetic
agccagcgcttgagcatccggctacccatcggcgtcaccgtacagtcgag

SEQ ID NO: 2087 - DNA, 50 bp, Artificial
  Synthetic
gctaatctcgcgcaggatcacggtaaactggttgcctttcagcgcgccta

SEQ ID NO: 2088 - DNA, 50 bp, Artificial
  Synthetic
cgtttttcccggcatagctaaagaagttgagcggcgaaccatcgccaaag

SEQ ID NO: 2089 - DNA, 50 bp, Artificial
  Synthetic
gcagcccgggtccgcgcagtgcatgcagccatccttgcggatgagccatt

SEQ ID NO: 2090 - DNA, 50 bp, Artificial
  Synthetic
cagccgacgacaagcggtgccatcctcacggaataaatggcaacgttctg

SEQ ID NO: 2091 - DNA, 50 bp, Artificial
  Synthetic
agttttcaatcgctcgcagagtatgaacgccgtagtaagcgtccgcggga

SEQ ID NO: 2092 - DNA, 50 bp, Artificial
  Synthetic
ccatggtgtagtgcgcggtcgggcgcaccgggatcggctctttcaccgga

SEQ ID NO: 2093 - DNA, 50 bp, Artificial
  Synthetic
cggcactacgtgaacccttcactaaaatggtcattattttgtgctccgcc

SEQ ID NO: 2094 - DNA, 50 bp, Artificial
  Synthetic
aaggcgagtttttgcagacgggcgatcatgcgcgggcccatccacaacga

SEQ ID NO: 2095 - DNA, 50 bp, Artificial
  Synthetic
gtaaatccgcagcttcgccgcgcgatactgctgcagccccagcgggtagc

SEQ ID NO: 2096 - DNA, 50 bp, Artificial
  Synthetic
gtgagccaatcagcgtgccgtagacggagtggcgtttcatgtacaggctg

SEQ ID NO: 2097 - DNA, 50 bp, Artificial
  Synthetic
aaccttcatcggacttgctgttcatatgcaggaagtacacgaggtgtacc

SEQ ID NO: 2098 - DNA, 50 bp, Artificial
  Synthetic
cacacgacgtccaggaagtgccagaacaggctcaggcacaggatacgcgt

SEQ ID NO: 2099 - DNA, 50 bp, Artificial
  Synthetic
tggtagaggcgctaattgcgaacggcgcaccggacgcggccatctgagaa

SEQ ID NO: 2100 - DNA, 50 bp, Artificial
  Synthetic
gttctgcgttaaacacgcgagcgatatactcttccgcttctttgtgcggg

SEQ ID NO: 2101 - DNA, 50 bp, Artificial
  Synthetic
acatgttgcgccagcgggtgtcctcgatcttggaacggtagtcaaaaccg

SEQ ID NO: 2102 - DNA, 50 bp, Artificial
  Synthetic
cgatgtagatatccaggaagctggaggtacgaccgaaggacattgccgcg

SEQ ID NO: 2103 - DNA, 50 bp, Artificial
  Synthetic
gctttatccatcaggctacgaccggaatagctcatccatacggcgagaca

SEQ ID NO: 2104 - DNA, 50 bp, Artificial
  Synthetic
aacgttttcagagatggagttaccaccccaggaaccacaacccagagtca

SEQ ID NO: 2105 - DNA, 50 bp, Artificial
  Synthetic
tcgccgcctcgcgcatcgcctgcgcttcgctgccgccctgggccttcacg

SEQ ID NO: 2106 - DNA, 50 bp, Artificial
  Synthetic
ttccaggatatctttgcgtaactgcggcaggtaatgcggctccgcgtctc

SEQ ID NO: 2107 - DNA, 50 bp, Artificial
  Synthetic
catcgactgaaatcgcgttgttaacctgggttttaccctggcggaacgcc

SEQ ID NO: 2108 - DNA, 50 bp, Artificial
  Synthetic
gtcgtatttttgctgatcgtagcgggccacgttaaccggctggccaaaaa

SEQ ID NO: 2109 - DNA, 50 bp, Artificial
  Synthetic
ccaagaaccgacagcgtggcattgagaaaatgattgcgtcgccacgcaat

SEQ ID NO: 2110 - DNA, 50 bp, Artificial
  Synthetic
agaacaggaacatgtcgatggcgaggaacacgccgataacgccgcccagg

SEQ ID NO: 2111 - DNA, 50 bp, Artificial
  Synthetic
ggaatggttttacgaacaccttgtcgtataaccagtcgaagccccaggca

SEQ ID NO: 2112 - DNA, 50 bp, Artificial
  Synthetic
gacgtacggcccaaacagcgcaatgcccacttctttggcgttaatcgccg

SEQ ID NO: 2113 - DNA, 50 bp, Artificial
  Synthetic
tcttccggatacatccgggtttcacgtttggcgaaggcatgcaggccaat

SEQ ID NO: 2114 - DNA, 50 bp, Artificial
  Synthetic
ggcacgatagcgaaggccagcagcagcgaggtaaaggcgataaccggcgc

SEQ ID NO: 2115 - DNA, 50 bp, Artificial
  Synthetic
ggtagcaggcgatgcagcggttcatttcgtgcgaaataaacggccccaga

SEQ ID NO: 2116 - DNA, 50 bp, Artificial
  Synthetic
tcccagacgcccggattcttcacccggccggagaagcccatcagcttggt

SEQ ID NO: 2117 - DNA, 50 bp, Artificial
  Synthetic
caggaattgcctccggcgtcagatggctgtgagtatcctcatcaatcatc

SEQ ID NO: 2118 - DNA, 50 bp, Artificial
  Synthetic
cggaagaaccggaaccgccgtggaacacgaagttcaggctgttgtgcggc

SEQ ID NO: 2119 - DNA, 50 bp, Artificial
  Synthetic
atatgcagcttacgacggtgctgatgcacaaagctgacggcttcctgcag

SEQ ID NO: 2120 - DNA, 50 bp, Artificial
  Synthetic
tgcggcaggttacgcgacaggaccaccagggtcatattctccggctgatg

SEQ ID NO: 2121 - DNA, 50 bp, Artificial
  Synthetic
aacgatgcgaatcataccaggcttaatggcggtgagcagcggcgcgtggc

SEQ ID NO: 2122 - DNA, 50 bp, Artificial
  Synthetic
gcgcggatacttcagtaccggccagggtgtaacgatagatgttatcgacg

SEQ ID NO: 2123 - DNA, 50 bp, Artificial
  Synthetic
aaatttgttgctgacaacgtacagcttgtccagacggccttcatcatagg

SEQ ID NO: 2124 - DNA, 50 bp, Artificial
  Synthetic
agtatcctgactttctggcgactatatcaatgttaagtggttgatcgata

SEQ ID NO: 2125 - DNA, 50 bp, Artificial
  Synthetic
ggaacacccaccacatcaggccgaaggtgaggatatcgaaaatcgagctg

SEQ ID NO: 2126 - DNA, 50 bp, Artificial
  Synthetic
aacagcgcgataatcacgatagccccgaggtcatcaataatcgccagcgc

SEQ ID NO: 2127 - DNA, 50 bp, Artificial; identical to SEQ ID NO: 1963
  Synthetic

SEQ ID NO: 2128 - DNA, 50 bp, Artificial
  Synthetic
gtaatacggtatgaagtggcgcccatctcatccgctttctgcgccagctg

SEQ ID NO: 2129 - DNA, 50 bp, Artificial
  Synthetic
tgcgcaatctccgtcagcttgcggctgcggatgtactggccgagggaatg

SEQ ID NO: 2130 - DNA, 50 bp, Artificial; identical to SEQ ID NO: 1983
  Synthetic

SEQ ID NO: 2131 - DNA, 50 bp, Artificial
  Synthetic
gtacggcattttcatgttcgcgcagacaggtgacgcgtaagacatagcgt

SEQ ID NO: 2132 - DNA, 50 bp, Artificial
  Synthetic
cggtcatgctgctggattggatccccgtgaggcttaacaccagcccgaac

SEQ ID NO: 2133 - DNA, 50 bp, Artificial
  Synthetic
gcatttcatgcatatccatcggggaagatgctaccgcgccgacggaaacc

SEQ ID NO: 2134 - DNA, 50 bp, Artificial
  Synthetic
actgggcgattttgaaatagataattagcccggtgccatcaatcagcgtg

SEQ ID NO: 2135 - DNA, 50 bp, Artificial
  Synthetic
tgagcaacgactgggctatcatgtttggccggtaattgagcgcttccgcc

SEQ ID NO: 2136 - DNA, 50 bp, Artificial
  Synthetic
accagctggtggttgacgaaggcgcccagcagcgtttcgcccggcgcgtt

SEQ ID NO: 2137 - DNA, 50 bp, Artificial
  Synthetic
gaaggcctggctcaccaacccctggtgcagccatgtggtctctttttccg

SEQ ID NO: 2138 - DNA, 50 bp, Artificial
  Synthetic
ccagctcgctttcagcaaagccagccaccgcgatagcgatgcgatagtgg

SEQ ID NO: 2139 - DNA, 50 bp, Artificial
  Synthetic
tgcccgcgacacgcaaataacacttcacatcagccagactactgccacca

SEQ ID NO: 2140 - DNA, 50 bp, Artificial
  Synthetic
cgtgcttacgctaatgccggtggtcttgctgacggcaacttccgcaccgt

SEQ ID NO: 2141 - DNA, 50 bp, Artificial
  Synthetic
ccgctccagagtcataacgcaaatcaacgtagctaatccgtttgccatcg

SEQ ID NO: 2142 - DNA, 50 bp, Artificial
  Synthetic
tatcactggtcacgacattgccagcataaggaattaccttagtgtggcgc

SEQ ID NO: 2143 - DNA, 50 bp, Artificial
  Synthetic
cgccaagttttaactgaatataaggaaagccggtgcgcatccgcttgaga

SEQ ID NO: 2144 - DNA, 50 bp, Artificial
  Synthetic
gccttccagattaaacagcgcctgatactgcttggtcagggcgtttttcg

SEQ ID NO: 2145 - DNA, 50 bp, Artificial
  Synthetic
acttcgactttgtcctgccagctttcacgggcggttaataccagaatcgg

SEQ ID NO: 2146 - DNA, 50 bp, Artificial
  Synthetic
gtgtaccagggcgtaagcgtaaaaaacggtttacggtcagtggcaacgtg

SEQ ID NO: 2147 - DNA, 50 bp, Artificial
  Synthetic
gcagtagcgcctccagttgcggatgcgccagcttcggttgctgttcccgc

SEQ ID NO: 2148 - DNA, 50 bp, Artificial
  Synthetic
cggaaacaaacgtcttgcccgctctcgtcgaccagatacagttccccttg

SEQ ID NO: 2149 - DNA, 50 bp, Artificial
  Synthetic
cggaggaaacagaatcagtgtgcgtcgctttcagctggcggatcgccgcc

SEQ ID NO: 2150 - DNA, 50 bp, Artificial
  Synthetic
aaatgacagtcataccaagatttttgcgggtaacttccagcaatgcgtca

SEQ ID NO: 2151 - DNA, 50 bp, Artificial
  Synthetic
acaagtgagtgatccccaatgtggcacaacgatcttctaccagtttagcc

SEQ ID NO: 2152 - DNA, 50 bp, Artificial
  Synthetic
ttttgaattgctgaacgtaatgaggcactgacgcgagattcatcttccgg

SEQ ID NO: 2153 - DNA, 50 bp, Artificial
  Synthetic
agatcgccgtagaacatcgccacgccaatgctacagtgcggacggagttg

SEQ ID NO: 2154 - DNA, 50 bp, Artificial
  Synthetic
aaaatccagcgcgcgataaaccgttggcggcttggcttgcggttcagctt

SEQ ID NO: 2155 - DNA, 50 bp, Artificial
  Synthetic
gttcaccagatcaacatcaccgataccttctacgtctttcgctttagatt

SEQ ID NO: 2156 - DNA, 50 bp, Artificial
  Synthetic
cgtcagaagacagctgatcgattttagcgttgctggagcaacctgccagc

SEQ ID NO: 2157 - DNA, 50 bp, Artificial
  Synthetic
tcgcgctgctgttccggagtcagagagttaaagcgaactgcataaccgga

SEQ ID NO: 2158 - DNA, 50 bp, Artificial
  Synthetic
cgctgcgaattaccgcctgactttctgcggtttgttgtttgaattgttca

SEQ ID NO: 2159 - DNA, 50 bp, Artificial
  Synthetic
atgcattgtctccagttcgctaacattaacaggaggctgttcgtgccggg

SEQ ID NO: 2160 - DNA, 50 bp, Artificial
  Synthetic
taatgcctttaataatgctgtgcgtacggtcgcgctcgccggagttcgcg

SEQ ID NO: 2161 - DNA, 50 bp, Artificial
  Synthetic
gcggcccgccattaagctgcatgtactggctggcgtagggcatattttga

SEQ ID NO: 2162 - DNA, 50 bp, Artificial
  Synthetic
tccagacggagtccgcgaggccaacataaataatgctgccgggcatcggc

SEQ ID NO: 2163 - DNA, 50 bp, Artificial
  Synthetic
cacatagacatcgttctgcacatactcgcgcacatgggtacgcacgcgcg

SEQ ID NO: 2164 - DNA, 50 bp, Artificial
  Synthetic
tgaagaactttagcgccgaagtaggaaagctccatcgcttcctggtagga

SEQ ID NO: 2165 - DNA, 50 bp, Artificial
  Synthetic
ccatttcgattgccatattgcacagggtcatacgaccttccatgcttaaa

SEQ ID NO: 2166 - DNA, 50 bp, Artificial
  Synthetic
ggcggaaggcaacatccccatcgagccagtgatcattgcgcactcgtcag

SEQ ID NO: 2167 - DNA, 50 bp, Artificial
  Synthetic
cgctgccaacaatggctttgtttgccgggatcggcatattacaaatctgg

SEQ ID NO: 2168 - DNA, 50 bp, Artificial
  Synthetic
ggagaaccttcctggcagaacggagaatcatcaccgaagaactgctggaa

SEQ ID NO: 2169 - DNA, 50 bp, Artificial
  Synthetic
gcgcacttatgtcagcagcgctggcatcgggctgaacgaacaaaaagacc

SEQ ID NO: 2170 - DNA, 50 bp, Artificial
  Synthetic
ccgttgagtcaccctcgatagccacgtcaaatagacctttctgtgagtta

SEQ ID NO: 2171 - DNA, 50 bp, Artificial
  Synthetic
gctgttgtaataccaataatttgctaaggcttctgactttctggccgcaa

SEQ ID NO: 2172 - DNA, 50 bp, Artificial
  Synthetic
cgccaccactgcaaaaatgaggcagcctactaaaaacgggatcagcccga

SEQ ID NO: 2173 - DNA, 50 bp, Artificial
  Synthetic
aaatccggccagggttcattcagttgattcacagcactgtcataatcttc

SEQ ID NO: 2174 - DNA, 50 bp, Artificial
  Synthetic
aaaaagttacgccgcgccccttccagttgatgcatttgcgtgacatcacg

SEQ ID NO: 2175 - DNA, 50 bp, Artificial
  Synthetic
aaacaaagccgacgtgcttcgcgcgcaactttgcccgcgcttcttcgtcc

SEQ ID NO: 2176 - DNA, 50 bp, Artificial
  Synthetic
gctgatcgccaatcttataggtcacatcataaccgagcattttttctgac

SEQ ID NO: 2177 - DNA, 50 bp, Artificial
  Synthetic
ccaaaccatgcgccaaggctgtaataaggcaaattgcggatcacactgtt

SEQ ID NO: 2178 - DNA, 50 bp, Artificial
  Synthetic
gattgctcaatttttaaatcacggctggcaacgctggcattacccattac

SEQ ID NO: 2179 - DNA, 50 bp, Artificial
  Synthetic
accgtcgcggcctttttctgttactgcaccaacaccagcgccaacagctg

SEQ ID NO: 2180 - DNA, 50 bp, Artificial
  Synthetic
ccgccacagcacgcaattcatcgctgtccgcttcatgacgcagctgatga

SEQ ID NO: 2181 - DNA, 50 bp, Artificial
  Synthetic
cgccgcgcagcggatagagcagagcaccttaaactgtgccgcggtaatat

SEQ ID NO: 2182 - DNA, 50 bp, Artificial
  Synthetic
tgtaaattttgttctgggtttccatgtgcgccagcatgttagctttgcgc

SEQ ID NO: 2183 - DNA, 50 bp, Artificial
  Synthetic
ctttgatattcatttggtcagagatttgaatggttccctgacctgccatc

SEQ ID NO: 2184 - DNA, 50 bp, Artificial
  Synthetic
tcacttcgcaaaccagccatagtccggcaaacatgatggtgatatctgaa

SEQ ID NO: 2185 - DNA, 50 bp, Artificial
  Synthetic
aacaggaacataccgctgttccagtaatattcgccgcttgccacataggc

SEQ ID NO: 2186 - DNA, 50 bp, Artificial
  Synthetic
ggcagacgcagccccagttccgccatcgtcagccgctcaaatgcggcttc

SEQ ID NO: 2187 - DNA, 50 bp, Artificial
  Synthetic
taacgaaatcttccggctgttcctgttgcagcatcatccactgcattttt

SEQ ID NO: 2188 - DNA, 50 bp, Artificial
  Synthetic
tggtgaaatgttgacttgcatggtcgtggctaccggtgcataaataactt

SEQ ID NO: 2189 - DNA, 50 bp, Artificial
  Synthetic
ccctgcgagaatcatagcatcggttttaggcgttttgataccaaactgtt

SEQ ID NO: 2190 - DNA, 50 bp, Artificial
  Synthetic
tactccaccaccatccgcaggaagatgtcgtaatcctgtgccgctttcag

SEQ ID NO: 2191 - DNA, 50 bp, Artificial
  Synthetic
agttcagaatcacccctttcaccggaataccgttttgctcaaagcggctc

SEQ ID NO: 2192 - DNA, 50 bp, Artificial
  Synthetic
attcgttatcccagtgaccaaacagcatcactttgccgcgcatctcaggt

SEQ ID NO: 2193 - DNA, 50 bp, Artificial
  Synthetic
ttaccagttatgaatgtcgctggctgtatccgtcatgtaacggacaccgc

SEQ ID NO: 2194 - DNA, 50 bp, Artificial
  Synthetic
tgcactctgggagtcattgcggccttgccagaaccagaatgcggcgatgg

SEQ ID NO: 2195 - DNA, 50 bp, Artificial
  Synthetic
cgtaatgatcgcgatcgccaatttgtaatttgattgatggcagtagggtg

SEQ ID NO: 2196 - DNA, 50 bp, Artificial
  Synthetic
tttatcgatggtcacgctggcttctccttttttgcctttcaccgttttac

SEQ ID NO: 2197 - DNA, 50 bp, Artificial
  Synthetic
gtaaatatctcggcaatcatccgttggcgggtaagaatatccggctcttt

SEQ ID NO: 2198 - DNA, 50 bp, Artificial
  Synthetic
tgctgctgggagaatttctccagcgcagtacggcagattttgtccgccac

SEQ ID NO: 2199 - DNA, 50 bp, Artificial
  Synthetic
cccaacatcaatagcacaatcagcgccgccagttttaccagcacgctgaa

SEQ ID NO: 2200 - DNA, 50 bp, Artificial
  Synthetic
gaaggttgcacctgcacctgtcaggcttgcttctgcaaacacagagaaag

SEQ ID NO: 2201 - DNA, 50 bp, Artificial
  Synthetic
atacccacgccaccgccaacgtacagcatcggtttttgcgcttttgccag

SEQ ID NO: 2202 - DNA, 50 bp, Artificial
  Synthetic
cccaatcaggcgtttcgataccatctacggcttttagttccgtacctggt

SEQ ID NO: 2203 - DNA, 50 bp, Artificial
  Synthetic
ttacgttcgcccagagacgcgaacctgcaccgattttgctgtttttacct

SEQ ID NO: 2204 - DNA, 50 bp, Artificial
  Synthetic
cgtcatcgtcacttaacacatcaaaggctttttgctggatttgcgccagt

SEQ ID NO: 2205 - DNA, 50 bp, Artificial
  Synthetic
gcaatttcgacgcgctgtttatctttacccagcttcaccaggcgttcggc

SEQ ID NO: 2206 - DNA, 50 bp, Artificial
  Synthetic
tccctatttcgcgctcttcacccagcgcctgcaaaatgccaaaaactttt

SEQ ID NO: 2207 - DNA, 50 bp, Artificial
  Synthetic
catgatgaatgttgcgacgcaccgagagcgtcgccgcgcccagagaacaa

SEQ ID NO: 2208 - DNA, 50 bp, Artificial
  Synthetic
ggtcaagcgcggcgctcacttcatctttgggaccgctcagatcgataaac

SEQ ID NO: 2209 - DNA, 50 bp, Artificial
  Synthetic
agggtgattttcgggaagttggcgtaatccagaccggagaaaatttcatc

SEQ ID NO: 2210 - DNA, 50 bp, Artificial
  Synthetic
cattacgtgggttagcaaacactttcccgcccgtgcgtcgcgcatcttcg

SEQ ID NO: 2211 - DNA, 50 bp, Artificial
  Synthetic
gcgcacagtcaaccaccatgcgaatacgctcttcattaccgatattgcca

SEQ ID NO: 2212 - DNA, 50 bp, Artificial
  Synthetic
atccgcgcaggaatgttgaagcaagatcggcgggtgccttatcttcttca

SEQ ID NO: 2213 - DNA, 50 bp, Artificial
  Synthetic
ccgctctttgagatagttatcgcttagcgcggcaaactgttcggcaaatt

SEQ ID NO: 2214 - DNA, 50 bp, Artificial
  Synthetic
cgccgctcaccagctgcaagagaaaccatttttgtttttggccgatacaa

SEQ ID NO: 2215 - DNA, 50 bp, Artificial
  Synthetic
acgacagcacctcttcgcgccgttccagtggatgacaccagaccagcgaa

SEQ ID NO: 2216 - DNA, 50 bp, Artificial
  Synthetic
ataagcgtacgccagcgaacattaccgcgtcctttttcaggcaacgagtc

SEQ ID NO: 2217 - DNA, 50 bp, Artificial
  Synthetic
tcgtgcagcatacgtagcgccaggtcagtaattggcgaaccaatcttccg

SEQ ID NO: 2218 - DNA, 50 bp, Artificial
  Synthetic
gccgccagagcaatagcgatagccaccgcgctgagaatcaatgcggtatt

SEQ ID NO: 2219 - DNA, 50 bp, Artificial
  Synthetic
tcagtgggtacattggcagcacgcatggcgtaaaggcgataccaataccg

SEQ ID NO: 2220 - DNA, 50 bp, Artificial
  Synthetic
aagagtcgacgatcaggtctttcttctctttggtcacaaagcggtcggcc

SEQ ID NO: 2221 - DNA, 50 bp, Artificial
  Synthetic
cgacaggcaggtgtaatgtggcaaaactcactgctgcaattcaccagcga

SEQ ID NO: 2222 - DNA, 50 bp, Artificial
  Synthetic
ctatacgcagaccgtcgttgatctggaagctgttatccatatgcggatcg

SEQ ID NO: 2223 - DNA, 50 bp, Artificial
  Synthetic
acggaacatagttctcactgtagccatgctgttcggtatgcagatccagc

SEQ ID NO: 2224 - DNA, 50 bp, Artificial
  Synthetic
cagcatatttcgccgatgaggtcatgtggcagtcgataaccacaatcagc

SEQ ID NO: 2225 - DNA, 50 bp, Artificial
  Synthetic
tagtgtgatagcttttcttcgctactccacggctgcgggcgcgtagttca

SEQ ID NO: 2226 - DNA, 50 bp, Artificial
  Synthetic
ctactttgttgccatctttgttatagatttctgcagcgtttgcagtacct

SEQ ID NO: 2227 - DNA, 50 bp, Artificial
  Synthetic
acccgatgttcttcccacaggccatctgcggcgcgaaaggtacgaatacc

SEQ ID NO: 2228 - DNA, 50 bp, Artificial
  Synthetic
acgagacggtaaaattctccgggatgtgcattttctggctgttacgggca

SEQ ID NO: 2229 - DNA, 50 bp, Artificial
  Synthetic
ggtcggaagcgagagtaattaaactgatgtgtccctttactggcctggcg

SEQ ID NO: 2230 - DNA, 50 bp, Artificial
  Synthetic
cacgggtaggcgaaagtacaggtggcgaggctcgccaacaataccagccc

SEQ ID NO: 2231 - DNA, 50 bp, Artificial
  Synthetic
gaacttggttgccgccgtgatacgcgttttaccgtcagaggctttatgcc

SEQ ID NO: 2232 - DNA, 50 bp, Artificial
  Synthetic
acgatacgaccacgataacggggcggcagatagaccggctcttccgggta

SEQ ID NO: 2233 - DNA, 50 bp, Artificial
  Synthetic
tcatcgcctgattcagcgccagatctttacgctccagcgagtgcatatag

SEQ ID NO: 2234 - DNA, 50 bp, Artificial
  Synthetic
ccgccgatgttgatagccagcaggaacatcaggtacatcacaaagaggaa

SEQ ID NO: 2235 - DNA, 50 bp, Artificial
  Synthetic
gtcagcatggagcggaaattcgctttatcctgcactttatctaaccacag

SEQ ID NO: 2236 - DNA, 50 bp, Artificial
  Synthetic
aacgtcaggccaagtacgtttttcacatcacggttcagtaaccccgcgcg

SEQ ID NO: 2237 - DNA, 50 bp, Artificial
  Synthetic
agttgttcacaggtcagctccagttcaacgtcggttttaatcgtcgccag

SEQ ID NO: 2238 - DNA, 50 bp, Artificial
  Synthetic
gcgaaacggcggtcaatttcgtccattcgatcccacgggttatcgataga

SEQ ID NO: 2239 - DNA, 50 bp, Artificial
  Synthetic
gataagccggagaggtggtgtaactcagtaccagatcgctttcacctttt

SEQ ID NO: 2240 - DNA, 50 bp, Artificial
  Synthetic
cgggcataatttgagcgccatccctgtcggcatagcgctacgtacgccaa

SEQ ID NO: 2241 - DNA, 50 bp, Artificial
  Synthetic
atacgtcgccagaccgctggcgcgtttggtcataaagttgtcggtctgcg

SEQ ID NO: 2242 - DNA, 50 bp, Artificial
  Synthetic
aaaaccgcgtcacgcagctgactggtgatatcgcgcatggttgcttccag

SEQ ID NO: 2243 - DNA, 50 bp, Artificial
  Synthetic
aatccggccagggttcattcagttgattcacagcactgtcataatcttcc

SEQ ID NO: 2244 - DNA, 50 bp, Artificial
  Synthetic
taaggatgttctgcccgttatcttccggccagcgcaaaccaagaatttgt

SEQ ID NO: 2245 - DNA, 50 bp, Artificial
  Synthetic
gcggcaggtacaaagcgcgtgttgtaccattcgccgttatagcaaacgcg

SEQ ID NO: 2246 - DNA, 50 bp, Artificial
  Synthetic
ttgtggcgggtgacgataccagcgtcgtcaaactggttcagtacgcgata

SEQ ID NO: 2247 - DNA, 50 bp, Artificial
  Synthetic
tctcgcgtacgtcgatttttttacccagatattccggtgtacgaccaatc

SEQ ID NO: 2248 - DNA, 50 bp, Artificial
  Synthetic
aatcaaacagcgtcggcggtggctcacccggtccacgaccggagaggaag

SEQ ID NO: 2249 - DNA, 50 bp, Artificial
  Synthetic
cggtgttaaccagagttgccagcgcgattgctgaccgagttgctgtaaca

SEQ ID NO: 2250 - DNA, 50 bp, Artificial
  Synthetic
ggaaacgcatactgaatacggcgggaaagttcgccagccagggcgtcaat

SEQ ID NO: 2251 - DNA, 50 bp, Artificial
  Synthetic
gctatcgacaatcagtaaatcaccgtcactaattccaccatcaatcatag

SEQ ID NO: 2252 - DNA, 50 bp, Artificial
  Synthetic
cagacgtcatccacggggagagcagacattaatttacgctggcgttccag

SEQ ID NO: 2253 - DNA, 50 bp, Artificial
  Synthetic
ggcgcgcatagccaaagtaggggataacagcggtgatacgacctgcggaa

SEQ ID NO: 2254 - DNA, 50 bp, Artificial
  Synthetic
aacacgtcaggattgcggaagggacaatatgccaccagtcaccctgtgcc

SEQ ID NO: 2255 - DNA, 50 bp, Artificial
  Synthetic
cagaatggtgctcagcacatctttttgttctgccagccatagcgaaaggg

SEQ ID NO: 2256 - DNA, 50 bp, Artificial
  Synthetic
cagattttttataggctttgttccagtcattgcctagtacgttcatggcg

SEQ ID NO: 2257 - DNA, 50 bp, Artificial
  Synthetic
ctgggaaatcgaaacgttatgcagtccttctgccgcccaatccagaacgc

SEQ ID NO: 2258 - DNA, 50 bp, Artificial
  Synthetic
ggtcaacgatcagcgccatacgctcatcgatgttagaaaccagtttctgg

SEQ ID NO: 2259 - DNA, 50 bp, Artificial
  Synthetic
aaattacggcaggggccgcaccacggtgcccagaagtcgatcaccacagg

SEQ ID NO: 2260 - DNA, 50 bp, Artificial
  Synthetic
taatgccaatgcattctggctggtggtcagcaattgaccgctgttcgcca

SEQ ID NO: 2261 - DNA, 50 bp, Artificial
  Synthetic
atccgccagattttttatccagcccgacgggctaactttgcgtgccgcgc

SEQ ID NO: 2262 - DNA, 50 bp, Artificial
  Synthetic
aagacagttggcaaaggttcgccatattttcgcgtcgcctgatcgcgcgc

SEQ ID NO: 2263 - DNA, 50 bp, Artificial
  Synthetic
agatggtttccacatccatggaacggtcttcacccaggcgcatgatggag

SEQ ID NO: 2264 - DNA, 50 bp, Artificial
  Synthetic
aaagcaaaccagacggtgccgacaggcttctcttcactgccgccatccgg

SEQ ID NO: 2265 - DNA, 50 bp, Artificial
  Synthetic
ggcgagatggaaagcgtgatccaactgcgcatgttcgatcagcgaaatct

SEQ ID NO: 2266 - DNA, 50 bp, Artificial
  Synthetic
gcagaagctttagcgcgcttacgttcggtagtcggtttttcatagaactc

SEQ ID NO: 2267 - DNA, 50 bp, Artificial
  Synthetic
ctcccccacaatcaacacgtaggtatcaatacctgtatccctgactgata

SEQ ID NO: 2268 - DNA, 50 bp, Artificial
  Synthetic
agacgcagatgatcgcgcagtttcgccatctccatttcatgagcggtcac

SEQ ID NO: 2269 - DNA, 50 bp, Artificial
  Synthetic
ggaacaccagcatcaccaggagagcaataagcaactctcgcaccatgatt

SEQ ID NO: 2270 - DNA, 50 bp, Artificial
  Synthetic
ccgtcgatggctgcggcttcgatcaacgaacggggaatggattgcagcgc

SEQ ID NO: 2271 - DNA, 50 bp, Artificial
  Synthetic
tgttcgtagttgcctttataggtcggtacaattttgtaatccgggttttc

SEQ ID NO: 2272 - DNA, 50 bp, Artificial
  Synthetic
cgggtctggatagcaaaataagtttgccctgccgcaataaccggtttcgc

SEQ ID NO: 2273 - DNA, 50 bp, Artificial
  Synthetic
ttggcgaagcacagcagccagatcactttgtttttcagcacatactcaac

SEQ ID NO: 2274 - DNA, 50 bp, Artificial
  Synthetic
agaggcaaaatcatctatcaggtagagacaccgccgcccgctttcacggg

SEQ ID NO: 2275 - DNA, 50 bp, Artificial
  Synthetic
cggtcagcgacaacgtaccgtcagcaacctgtaacagcagattaccgaga

SEQ ID NO: 2276 - DNA, 50 bp, Artificial
  Synthetic
gccgcgcgcgccagttggttagatttaccttcaacgaagttatcaaacgt

SEQ ID NO: 2277 - DNA, 50 bp, Artificial; identical to SEQ ID NO: 2199
  Synthetic

SEQ ID NO: 2278 - DNA, 50 bp, Artificial
  Synthetic
aaggttgcacctgcacctgtcaggcttgcttctgcaaacacagagaaagc

SEQ ID NO: 2279 - DNA, 50 bp, Artificial
  Synthetic
aatcaacgcgaagatcaatggtccccatccgcgatagccgctggcgtagt

SEQ ID NO: 2280 - DNA, 50 bp, Artificial
  Synthetic
agcacgtaatccagagttcgcagccccggcagctgttgataatctttgcg

SEQ ID NO: 2281 - DNA, 50 bp, Artificial
  Synthetic
ttccagcacgccgatggcctcgccgaggctggcgacggtcgcagtgtcga

SEQ ID NO: 2282 - DNA, 50 bp, Artificial
  Synthetic
aaccccaaacgctgcgcgatttccgcacgcgtcggcggcatacctgtctg

SEQ ID NO: 2283 - DNA, 50 bp, Artificial
  Synthetic
atatgcagccccatcaccagccagacatccagcacaatgttgaggatatt

SEQ ID NO: 2284 - DNA, 50 bp, Artificial
  Synthetic
caacgtaacggcgctgcccttcggcatataaggtgtcgaaagcgagcgag

SEQ ID NO: 2285 - DNA, 50 bp, Artificial
  Synthetic
accgacgaaaacggatgttgagtgtgctggccagaaacatcattacggca

SEQ ID NO: 2286 - DNA, 50 bp, Artificial
  Synthetic
cgcgggagaaggtctgctgcgagacataacccaggtccattgcgatatca

SEQ ID NO: 2287 - DNA, 50 bp, Artificial
  Synthetic
  misc_feature (1)..(11): n is a, c, g, or t
nnnnnnnnnnngaggtggagttaggatcgccattgccgaaggtgagatct

SEQ ID NO: 2288 - DNA, 50 bp, Artificial
  Synthetic
ggctgctgccgtcgtagaagacgtgcccctggcgcagggcgacgatgcgt

SEQ ID NO: 2289 - DNA, 50 bp, Artificial
  Synthetic
cgccgcgggtggatttagccgctgcagagccggtcagaacgatgccgcca

SEQ ID NO: 2290 - DNA, 50 bp, Artificial
  Synthetic
acggtcgaactgcataccttcaaccacgtccagttcgtcctgcagaccgg

SEQ ID NO: 2291 - DNA, 50 bp, Artificial
  Synthetic
cacaatgttgctgaatcatctcgcccagctttttgagtcggttgcgcaga

SEQ ID NO: 2292 - DNA, 50 bp, Artificial
  Synthetic
ccaccggagccatcaccagcataaagcgaatcagcagcatactgacgcgg

SEQ ID NO: 2293 - DNA, 50 bp, Artificial
  Synthetic
tgggcatttgcgccaccaccccaatggaacccacaatagcaaacggtgcg

SEQ ID NO: 2294 - DNA, 50 bp, Artificial
  Synthetic
tggcagaaacgcatgttcggtacgtgcggaccgcggcacatatcgacata

SEQ ID NO: 2295 - DNA, 50 bp, Artificial
  Synthetic
gcccttggtgatcatcagcataatctgcaattcacgttcagacaaactgg

SEQ ID NO: 2296 - DNA, 50 bp, Artificial
  Synthetic
acgtaatgaatgataatgcccttttgcgcgtcggtgactaccggcacggt

SEQ ID NO: 2297 - DNA, 50 bp, Artificial; identical to SEQ ID NO: 2214
  Synthetic

SEQ ID NO: 2298 - DNA, 50 bp, Artificial
  Synthetic
agatcttgcaaccgttggttcagatcgtccgctgcctgattcaacgcatc

SEQ ID NO: 2299 - DNA, 50 bp, Artificial
  Synthetic
tatgcagactgatgccgagagtgagcagaatggctgtgcgcttgatcgat

SEQ ID NO: 2300 - DNA, 50 bp, Artificial
  Synthetic
aacgctatcgacgttaacacccgcctgttcaagtacgccgcggaccttat

SEQ ID NO: 2301 - DNA, 50 bp, Artificial
  Synthetic
  misc_feature (13)..(15): n is a, c, g, or t
attgtcggcatannnaagatggtcgccggagaagaaggtgacaccgccaa

SEQ ID NO: 2302 - DNA, 50 bp, Artificial
  Synthetic
ttgttaatgcgtaccatcagatcggcagcaatattattgaccgtcggcgt

SEQ ID NO: 2303 - DNA, 50 bp, Artificial
  Synthetic
ggtccatttacgggtacgcagctgaccttcgatataaacctgagaacctt

SEQ ID NO: 2304 - DNA, 50 bp, Artificial
  Synthetic
cgttaccgtattactgctgataacacccgtagtgcggttactttccgttt

SEQ ID NO: 2305 - DNA, 50 bp, Artificial
  Synthetic
gcggctgaacttcgttggtatacgcttctgcttcacgaatgtattgctgt

SEQ ID NO: 2306 - DNA, 50 bp, Artificial; identical to SEQ ID NO: 2220
  Synthetic

SEQ ID NO: 2307 - DNA, 50 bp, Artificial
  Synthetic
gatccttcaaaggtcacatgcccaaagcggtaacgttcgccactgttata

SEQ ID NO: 2308 - DNA, 50 bp, Artificial
  Synthetic
tcttctggatcggtcacttcgtaaccgagtttaaacgcttcaactgctgc

SEQ ID NO: 2309 - DNA, 50 bp, Artificial
  Synthetic
ccggtggtattttctgtcgggatcactttccccagcaggccgttaccaac

SEQ ID NO: 2310 - DNA, 50 bp, Artificial
  Synthetic
taatcgtattccggcgttaagcgcaacagcgtcatcggtacaccgatgtc

SEQ ID NO: 2311 - DNA, 50 bp, Artificial
  Synthetic
catgcggaaaatacgttgtccgcgcagtttaaaggagccgacctgcagga

SEQ ID NO: 2312 - DNA, 50 bp, Artificial
  Synthetic
aaccacagcagcataaagccagcaatacccagcaaggtggcgtacaccag

SEQ ID NO: 2313 - DNA, 50 bp, Artificial
  Synthetic
aacctgtaccactgccattgccaggattgttcccagaattacggccggag

SEQ ID NO: 2314 - DNA, 50 bp, Artificial
  Synthetic
tagccgccatgccgtaggtgatggagctgaacaacagcaagaaagtttca

SEQ ID NO: 2315 - DNA, 50 bp, Artificial
  Synthetic
aaactccagaataccggcgcaacctgaggtatcgcgccacgcatcgccgc

SEQ ID NO: 2316 - DNA, 50 bp, Artificial
  Synthetic
ggcggaacgaagctaccaatgaagatgccccagtcccacatgttacgcca

SEQ ID NO: 2317 - DNA, 50 bp, Artificial
  Synthetic
ccgtgaatcacaccagcacagacggcccacatcagcaataaaccatgcca

SEQ ID NO: 2318 - DNA, 50 bp, Artificial
  Synthetic
tacagcaactcgccttcgttcatcagtaacacgtcacggcactgctcggc

SEQ ID NO: 2319 - DNA, 50 bp, Artificial
  Synthetic
cggtggcttttactgattcccacgttgcacgcaggccagcaaaaacacgg

SEQ ID NO: 2320 - DNA, 50 bp, Artificial
  Synthetic
ccagccaccgcccggcagccaatgcaaaatgatcgcaaatatcatgacta

SEQ ID NO: 2321 - DNA, 50 bp, Artificial
  Synthetic
tagccgcgttgagctcggcaaataccgccagtacacagtccgggccaaat

SEQ ID NO: 2322 - DNA, 50 bp, Artificial
  Synthetic
gccaatatccagaccgtaaacttcataatgatcttcgcgcagcaggcgtt

SEQ ID NO: 2323 - DNA, 50 bp, Artificial; identical to SEQ ID NO: 2230
  Synthetic

SEQ ID NO: 2324 - DNA, 50 bp, Artificial; identical to SEQ ID NO: 2231
  Synthetic

SEQ ID NO: 2325 - DNA, 50 bp, Artificial
  Synthetic
tcaagtggaaaatcgccgcatcccatgcctgcacgccaagcgcgaggaac

SEQ ID NO: 2326 - DNA, 50 bp, Artificial
  Synthetic
cgatgttcaggttctggcgacgacggtgaagttgcagcagcagcgcaagg

SEQ ID NO: 2327 - DNA, 50 bp, Artificial
  Synthetic
taaggcccgaacagcgtaatacccactgctttagcactgattggcgtacc

SEQ ID NO: 2328 - DNA, 50 bp, Artificial; identical to SEQ ID NO: 2232
  Synthetic

SEQ ID NO: 2329 - DNA, 50 bp, Artificial
  Synthetic
cggttttcagcgcgaaccagatgaatggcggtaacaacgggccttgccag

SEQ ID NO: 2330 - DNA, 50 bp, Artificial
  Synthetic
tcgcttcttcgtcgtcaatggaaataaaggtgccatcggaagccggtgtc

SEQ ID NO: 2331 - DNA, 50 bp, Artificial
  Synthetic
agaagcccatcagcttggtgccagcatctttacttttcgagatgttctga

SEQ ID NO: 2332 - DNA, 50 bp, Artificial
  Synthetic
tgaacgattttcagcgcttcaatggacgccgcacgcgggtcttcgtagtg

SEQ ID NO: 2333 - DNA, 50 bp, Artificial
  Synthetic
ggaaaaatccgcggcaggtaacccttcgcggtgtgtgcgcagacgttcgt

SEQ ID NO: 2334 - DNA, 50 bp, Artificial
  Synthetic
cgacacaagaaaatgcgccaattttgagccagaccccagttacgcgtttt

SEQ ID NO: 2335 - DNA, 50 bp, Artificial
  Synthetic
ccgccggggcaaatggcgcgctacgaaacgcggaatgagggttatgttca

SEQ ID NO: 2336 - DNA, 50 bp, Artificial
  Synthetic
acacagaacacatcggcaatcgcctgttgcgccagcaggttaccggcatc

SEQ ID NO: 2337 - DNA, 50 bp, Artificial
  Synthetic
cagattttctacgccaactttacccgctgtgtagttagatttggttgcgg

SEQ ID NO: 2338 - DNA, 50 bp, Artificial
  Synthetic
  misc_feature (1)..(18): n is a, c, g, or t
nnnnnnnnnnnnnnnnnnttcggaacgcgcaccggtagaaagatcgtcca

SEQ ID NO: 2339 - DNA, 50 bp, Artificial
  Synthetic
accgcctcagaagacataccgcttatctcattaaccatatttttcatttc

SEQ ID NO: 2340 - DNA, 50 bp, Artificial
  Synthetic
cggtattgttatctgcgagaatcggttcaagttgtccgctcagcgtcatg

SEQ ID NO: 2341 - DNA, 50 bp, Artificial
  Synthetic
gctttatcgctgctgacggacgagaaatcagaggcaaacagtgcgctggc

SEQ ID NO: 2342 - DNA, 50 bp, Artificial
  Synthetic
ccgctcaccagcagcagaaccaggaaaataatcgccgcccagaaaacgca

SEQ ID NO: 2343 - DNA, 50 bp, Artificial
  Synthetic
gcgatacggaaaccggtcgggtaggcgtcgttagtggactgacatttgtt

SEQ ID NO: 2344 - DNA, 50 bp, Artificial
  Synthetic
gctgccgccagagtgatcaggttaatgatcacgataaccgggttttgtaa

SEQ ID NO: 2345 - DNA, 50 bp, Artificial
  Synthetic
tcataccgtcggtgtaatcacgcaggaaggttttacatgccagttttggc

SEQ ID NO: 2346 - DNA, 50 bp, Artificial
  Synthetic
gtcggacgtaccggaatcggttctttaaccggatcgacgccaacgtacgc

SEQ ID NO: 2347 - DNA, 50 bp, Artificial
  Synthetic
gacccatgcgtcgccgttatcagcagcaataattttgaacggcatgatgg

SEQ ID NO: 2348 - DNA, 50 bp, Artificial
  Synthetic
acgtacagcttcttcgagggtgagctccatgttatagcgtaaatcagcac

SEQ ID NO: 2349 - DNA, 50 bp, Artificial
  Synthetic
cagccgcgacgccaagagaggccatcgataagtcattagtgtagaacaat

SEQ ID NO: 2350 - DNA, 50 bp, Artificial
  Synthetic
cagctcaccgcgtttcacctggccgtattccaccatctgcgaggtcaggt

SEQ ID NO: 2351 - DNA, 50 bp, Artificial
  Synthetic
atgttgttgttgacgttgaaacgacgcgcggtttcagaaagcagtggggc

SEQ ID NO: 2352 - DNA, 50 bp, Artificial; identical to SEQ ID NO: 2242
  Synthetic

SEQ ID NO: 2353 - DNA, 50 bp, Artificial
  Synthetic
ggcggtgatctgcggctgagtaaaataccgccagttcattatctgataat

SEQ ID NO: 2354 - DNA, 50 bp, Artificial
  Synthetic
ggtagttgcctttgctgcttggttttaccgttggggtgtagtcacctggc

SEQ ID NO: 2355 - DNA, 50 bp, Artificial
  Synthetic
ggtgaaaatcaccgtaccgtgatcgcttgggaatgagtcatccgccgcat

SEQ ID NO: 2356 - DNA, 50 bp, Artificial
  Synthetic
tcatcccgcagacgaatacagccagaacttacccgcatgccaatgccgaa

SEQ ID NO: 2357 - DNA, 50 bp, Artificial
  Synthetic
cagctgacgacgcacatcgcgcgacgagtttgccgcctgatggcgtaaca

SEQ ID NO: 2358 - DNA, 50 bp, Artificial
  Synthetic
aatacgttcgcgcatccgttttgcttcatcagccagttgcgctaatcgct

SEQ ID NO: 2359 - DNA, 50 bp, Artificial
  Synthetic
gcgcaaatgacaaaatgatgtaagcaaccagggtaaacagcgccagaccg

SEQ ID NO: 2360 - DNA, 50 bp, Artificial; identical to SEQ ID NO: 2180
  Synthetic

SEQ ID NO: 2361 - DNA, 50 bp, Artificial
  Synthetic
ccggagtaatacacgccgcgcagcggatagagcagagcaccttaaactgt

SEQ ID NO: 2362 - DNA, 50 bp, Artificial
  Synthetic
tttgcgcgatttccgtcatcttacggctgcggatgtattggcctaatgaa

SEQ ID NO: 2363 - DNA, 50 bp, Artificial
  Synthetic
gtggcggcaataccaaacccgccccacaatgcataagcgacagacaagtc

SEQ ID NO: 2364 - DNA, 50 bp, Artificial; identical to SEQ ID NO: 2254
  Synthetic

SEQ ID NO: 2365 - DNA, 50 bp, Artificial
  Synthetic
gaacagcaaggccatgatcatcagcccctgaacgctgctcgactgtatcc

SEQ ID NO: 2366 - DNA, 50 bp, Artificial
  Synthetic
ccaccggttaagccaaatagcaaaatttgccagttggtgacctctctacc

SEQ ID NO: 2367 - DNA, 50 bp, Artificial
  Synthetic
gccaaggataaaagcacgggccgcaggcaaacttaactgccaaccgggcg

SEQ ID NO: 2368 - DNA, 50 bp, Artificial
  Synthetic
ttcgatgtcgcttaacgcctggcttagtttatacatcaccgaccatgcat

SEQ ID NO: 2369 - DNA, 50 bp, Artificial
  Synthetic
gctgtagccatcatcgccagattgacaaaaccggcaatcgtcatggcgat

SEQ ID NO: 2370 - DNA, 50 bp, Artificial
  Synthetic
acttcgccaacggcgatgctgctggcatctttgcctaacagataaccacc

SEQ ID NO: 2371 - DNA, 50 bp, Artificial; identical to SEQ ID NO: 2259
  Synthetic

SEQ ID NO: 2372 - DNA, 50 bp, Artificial
  Synthetic
tggctgtcgataagcccttcgtcccgcatacgagcgagatgctgtgatgt

SEQ ID NO: 2373 - DNA, 50 bp, Artificial; identical to SEQ ID NO: 2265
  Synthetic

SEQ ID NO: 2374 - DNA, 50 bp, Artificial
  Synthetic
aacacgattgtcggaggttccatcacctccagcacctgcttcattgcgat

SEQ ID NO: 2375 - DNA, 50 bp, Artificial
  Synthetic
cgccatcttgcaataatagcagttcgtctccttcactgagcagacgcagc

SEQ ID NO: 2376 - DNA, 50 bp, Artificial
  Synthetic
ccagttgctcactccagtaatcaagacagtaccagtttagcgtatgctgt

SEQ ID NO: 2377 - DNA, 50 bp, Artificial
  Synthetic
aggctgcctcgctggcggggcgacgctgttcagtaatcgcctttacaatc

SEQ ID NO: 2378 - DNA, 50 bp, Artificial
  Synthetic
ctacgtcgccggtgcgaataaacaggcgcgtcggcagctgttcagaacgc

SEQ ID NO: 2379 - DNA, 50 bp, Artificial
  Synthetic
ccgcctgtggcaggccatagcccgcataattacgagcaatatgaacaaca

SEQ ID NO: 2380 - DNA, 50 bp, Artificial
  Synthetic
tgaatgataatccagccctcaggcagctccagcagcagatatttagcccg

SEQ ID NO: 2381 - DNA, 50 bp, Artificial
  Synthetic
cttccagttgaatctctaaatcttcctgacggaaacctgccagcgcaagg

SEQ ID NO: 2382 - DNA, 50 bp, Artificial
  Synthetic
gcggtaatttccagttcgctctcagcaaaaccagccacagcgatagcaat

SEQ ID NO: 2383 - DNA, 50 bp, Artificial
  Synthetic
gggtagtctttggcgctctttaatataatgccgataaagcagcctacgtc

SEQ ID NO: 2384 - DNA, 50 bp, Artificial; identical to SEQ ID NO: 2279
  Synthetic

SEQ ID NO: 2385 - DNA, 50 bp, Artificial
  Synthetic
tggctcttacgcacaaatagccggaagccaaggcgttgttccagatcgct

SEQ ID NO: 2386 - DNA, 50 bp, Artificial
  Synthetic
caacggcggctttgaccagatggccctgatgcatttccagtttacgttca

SEQ ID NO: 2387 - DNA, 50 bp, Artificial
  Synthetic
ttaataatgctgtgcgtacggtcgcgctcgccggagttcgcgccataggt

SEQ ID NO: 2388 - DNA, 50 bp, Artificial; identical to SEQ ID NO: 2285
  Synthetic

SEQ ID NO: 2389 - DNA, 50 bp, Artificial; identical to SEQ ID NO: 2286
  Synthetic

SEQ ID NO: 2390 - DNA, 50 bp, Artificial; identical to SEQ ID NO: 2292
  Synthetic

SEQ ID NO: 2391 - DNA, 50 bp, Artificial
  Synthetic
tgatagccagttcccccagcgtgttgccgaagcccgctttcatggtgtgc

SEQ ID NO: 2392 - DNA, 50 bp, Artificial
  Synthetic
acatatcaacgtcaccgttcaggtgcgccgcttcgtggaaggttttcggg

SEQ ID NO: 2393 - DNA, 50 bp, Artificial
  Synthetic
aacattaacaggaggctgttcgtgccgggcctgttgcataagatctcgca

SEQ ID NO: 2394 - DNA, 50 bp, Artificial
  Synthetic
ccccttcttatttttctctacgcgctgtcggaataagggatcatgtagta

SEQ ID NO: 2395 - DNA, 50 bp, Artificial
  Synthetic
aggtaagttactaattggcaaggcatagctgcgccctgtttcatcaagga

SEQ ID NO: 2396 - DNA, 50 bp, Artificial
  Synthetic
cgctataaaacgctcttttacccctaagtcatagcgctgtttccagagtg

SEQ ID NO: 2397 - DNA, 50 bp, Artificial
  Synthetic
gtttaccacggtatgcagcaacttcacctttaggatcaagggtaaaaaca

SEQ ID NO: 2398 - DNA, 50 bp, Artificial
  Synthetic
tgttctaggcgctctacaatcttctcactttgagcttcatgtaaatgcaa

SEQ ID NO: 2399 - DNA, 50 bp, Artificial
  Synthetic
gtttcactgactggtttaagcttgcattttgctgtttcaaataagtacta

SEQ ID NO: 2400 - DNA, 50 bp, Artificial
  Synthetic
tgtttcaatcaatgcttgtgctgattttaaaagtggagccaagcccagtt

SEQ ID NO: 2401 - DNA, 50 bp, Artificial
  Synthetic
cctgctaaaccaggaggtaaacccataccagagttagctttttgcatttt

SEQ ID NO: 2402 - DNA, 50 bp, Artificial
  Synthetic
cctgacgagcaatccataaatttgaccccggttctaagttgtcatgttca

SEQ ID NO: 2403 - DNA, 50 bp, Artificial
  Synthetic
ttggtttgaccagagaactgtggttcttggaacttaagcgataaaatata

SEQ ID NO: 2404 - DNA, 50 bp, Artificial
  Synthetic
cacacttggattggtcgcatagcgattggcaatcagagctaaagagaccg

SEQ ID NO: 2405 - DNA, 50 bp, Artificial
  Synthetic
ctgtcatcagctgcaacaaccatagcatctacaaggtcaattgctttttc

SEQ ID NO: 2406 - DNA, 50 bp, Artificial
  Synthetic
agtaaacgtggtgagggtccataccaaatacgttagcacccacaaatgca

SEQ ID NO: 2407 - DNA, 50 bp, Artificial
  Synthetic
accaacaccgatcataggcacagcatcaagaagacccgcgattaagaaca

SEQ ID NO: 2408 - DNA, 50 bp, Artificial
  Synthetic
acagcttctttagcctgttgacgaatacgctcaccttcagccgcagcttg

SEQ ID NO: 2409 - DNA, 50 bp, Artificial
  Synthetic
cttgttaagcgcagaatcatctatcacttgatcgcctgcacgaattacaa

SEQ ID NO: 2410 - DNA, 50 bp, Artificial
  Synthetic
cgctgaccacgacccacaggaatcatggtatcaactgatttataaccagt

SEQ ID NO: 2411 - DNA, 50 bp, Artificial
  Synthetic
tgagtaatcgcggcttgacgcagcttgttatagatgagttgtaagtcttt

SEQ ID NO: 2412 - DNA, 50 bp, Artificial
  Synthetic
ttgcgtctaagtgagcaaatgtagttgcaggcgatgggtctgttaagtca

SEQ ID NO: 2413 - DNA, 50 bp, Artificial
  Synthetic
agcaattgttcagcatttttacgtgcttctaaaattgcagcttcatccaa

SEQ ID NO: 2414 - DNA, 50 bp, Artificial
  Synthetic
ttcccatttactgattacaagtacagcaagcgcgttacctacaacgttca

SEQ ID NO: 2415 - DNA, 50 bp, Artificial
  Synthetic
ccagttctttcctttcttcttttctttttctctaataatccccatcatat

SEQ ID NO: 2416 - DNA, 50 bp, Artificial
  Synthetic
ataaatgaagcctccggaaatacccaccatcaccagcataagctggctat

SEQ ID NO: 2417 - DNA, 50 bp, Artificial
  Synthetic
ctgcacctacagggttttgcatccagccattcgcaactaaaatccagagc

SEQ ID NO: 2418 - DNA, 50 bp, Artificial
  Synthetic
tgtcaaggttgttgtgatagaaagcagataatgcgcctactacaccaacc

SEQ ID NO: 2419 - DNA, 50 bp, Artificial
  Synthetic
gtttgcaccttcttcaacaccatgagttacagcagtacgtccatcaaata

SEQ ID NO: 2420 - DNA, 50 bp, Artificial
  Synthetic
gcgcggcactggttaagtaactgatgacatactgaacgaatcattgcagt

SEQ ID NO: 2421 - DNA, 50 bp, Artificial
  Synthetic
cgttgttgttcatataatcttttacgctcttcccaacgtttgcgttccca

SEQ ID NO: 2422 - DNA, 50 bp, Artificial
  Synthetic
aaatttatgcccacgatcattccattcaccacgaggtccgcctttaggac

SEQ ID NO: 2423 - DNA, 50 bp, Artificial
  Synthetic
agaccacgttgaatatcaccttcggcatctgccaaagttttaccttgttc

SEQ ID NO: 2424 - DNA, 50 bp, Artificial
  Synthetic
ttaattacacctgccaatgcttgtgggtcgatgcctagcttcacaccgag

SEQ ID NO: 2425 - DNA, 50 bp, Artificial
  Synthetic
caacacgatagcccggacttggaaaacctgctgaaccagcatgaatttca

SEQ ID NO: 2426 - DNA, 50 bp, Artificial
  Synthetic
gaagcgtttgttaaagcttgcaacacgcccttcattacttgcttgacgta

SEQ ID NO: 2427 - DNA, 50 bp, Artificial
  Synthetic
aacctttcgcgctgtcatctcccgaatttaagtcgaaagaatgtcctgta

SEQ ID NO: 2428 - DNA, 50 bp, Artificial
  Synthetic
aatcaggaactgctgcaaaatatcactttgtcgagcacccacagccatac

SEQ ID NO: 2429 - DNA, 50 bp, Artificial
  Synthetic
acctaccaaaatttgtgttggtttagtcgtaccatctgcttgtaaaacgc

SEQ ID NO: 2430 - DNA, 50 bp, Artificial
  Synthetic
tattgcatttttaaggcagggtgattgactgcttctagcatttcttgggc

SEQ ID NO: 2431 - DNA, 50 bp, Artificial
  Synthetic
tttcttgcgttgccttatctacattaatcgtcattggacttaattcatgt

SEQ ID NO: 2432 - DNA, 50 bp, Artificial
  Synthetic
aacgtgctgcttctgccaaatcgccttcgcgctgagctttttcaaaagca

SEQ ID NO: 2433 - DNA, 50 bp, Artificial
  Synthetic
cctcagggcttaaaattgcactgtttaccgagtcggcttccatactaaat

SEQ ID NO: 2434 - DNA, 50 bp, Artificial
  Synthetic
cgctcgtgattacatggtccacgtccggcaatcacttcattaaattcgtg

SEQ ID NO: 2435 - DNA, 50 bp, Artificial
  Synthetic
atgaagatggtaatggtccatcaaccattggcgtacaatcgtttgtgcaa

SEQ ID NO: 2436 - DNA, 50 bp, Artificial
  Synthetic
gaccgttcattagttcactatcgttgaactcacgagaaaaaatattgata

SEQ ID NO: 2437 - DNA, 50 bp, Artificial
  Synthetic
gtttaatcacgcgaatcgctaaaggcgcttgtttggcaattttggctgca

SEQ ID NO: 2438 - DNA, 50 bp, Artificial
  Synthetic
tcgtcatcttttagaccaagttcacgcatacaagccaaagattgggctgc

SEQ ID NO: 2439 - DNA, 50 bp, Artificial
  Synthetic
ataacccaccacagtcggtttacccgttgtaccagatgatgcatgtaaac

SEQ ID NO: 2440 - DNA, 50 bp, Artificial
  Synthetic
cggtagaagactgatcctgtaactcaattaaatcacgttgcatcgctgca

SEQ ID NO: 2441 - DNA, 50 bp, Artificial
  Synthetic
gctctgctgtaacaagtcctagctctacagcaacttgttttaaagtttta

SEQ ID NO: 2442 - DNA, 50 bp, Artificial
  Synthetic
tggctcaaacaactctgcaatttcagtttgcatcatgagtgaccaatccc

SEQ ID NO: 2443 - DNA, 50 bp, Artificial
  Synthetic
tgcgagactttgaatcgttgtctgtgcaaccacattatgctgatagtcaa

SEQ ID NO: 2444 - DNA, 50 bp, Artificial
  Synthetic
gcacctgtttcacgcataagtgttggtaaccaacttgttagcaagtaaac

SEQ ID NO: 2445 - DNA, 50 bp, Artificial
  Synthetic
ctttaaagacttcttcagccatatgcattgcagcgtttgcagcaggtaaa

SEQ ID NO: 2446 - DNA, 50 bp, Artificial
  Synthetic
ggtacgaccacacccaccaaagttagggtccattgcaccaataaacttat

SEQ ID NO: 2447 - DNA, 50 bp, Artificial
  Synthetic
tttcttcaaaacgtttcgcaataagtgtttggcgacgtggtgcccattca

SEQ ID NO: 2448 - DNA, 50 bp, Artificial
  Synthetic
gtcctctgacattcccatacgaccaaatttgacctgtacagtattatcaa

SEQ ID NO: 2449 - DNA, 50 bp, Artificial
  Synthetic
actaatcaatgagtcggtatcactatcagtagagaagctcttactgttct

SEQ ID NO: 2450 - DNA, 50 bp, Artificial
  Synthetic
gtttttccgtccatccctaagttggttaaataggtttttgaataaacggt

SEQ ID NO: 2451 - DNA, 50 bp, Artificial
  Synthetic
catcaccaatggcataaagccctgctacgttggttttacaatagtcatca

SEQ ID NO: 2452 - DNA, 50 bp, Artificial
  Synthetic
aagcacctaatgccataattgcaccttgcggtgggttaataatggcatcg

SEQ ID NO: 2453 - DNA, 50 bp, Artificial
  Synthetic
tatggtgactgagaatgctgagctgccgcagagaaacctgcgccaatcat

SEQ ID NO: 2454 - DNA, 50 bp, Artificial
  Synthetic
gtctttaaggttttcgctgtcaacgctgcaccaattgctaaaggaggccc

SEQ ID NO: 2455 - DNA, 50 bp, Artificial
  Synthetic
tggtcgtgactcgatcacatcgggaatcaggtttcgaagctgtgagagct

SEQ ID NO: 2456 - DNA, 50 bp, Artificial
  Synthetic
gcagctcacgttgaactgcgtcaagttcattacggtggcgaatttctaca

SEQ ID NO: 2457 - DNA, 50 bp, Artificial
  Synthetic
acagggcacggcaaggtctcatcattttgtccaagttttttggcattgat

SEQ ID NO: 2458 - DNA, 50 bp, Artificial
  Synthetic
tgcacctaaagcagcaccgatgtaaccaccgtttgtaccacccatgcttt

SEQ ID NO: 2459 - DNA, 50 bp, Artificial
  Synthetic
tatccgccatttgtaccgcccatgtttttaccaacggtgtaacccgcgcc

SEQ ID NO: 2460 - DNA, 50 bp, Artificial
  Synthetic
agcaccgaagccaatcatacttaaaatcgcaacaattttaatgcaggaaa

SEQ ID NO: 2461 - DNA, 50 bp, Artificial
  Synthetic
ggtagttggatgtgtacaggacggcgttcaaggaaacactgacgcaatac

SEQ ID NO: 2462 - DNA, 50 bp, Artificial
  Synthetic
cataatgtgctgccctgttcgagttgatcccgtaaacacgactttttgca

SEQ ID NO: 2463 - DNA, 50 bp, Artificial
  Synthetic
atttccgcgcggccacgccattcttttaatttattactgtcattgtcata

SEQ ID NO: 2464 - DNA, 50 bp, Artificial
  Synthetic
tcgttgtaagctgatctagagtttggtggatgagcttagaggtctgaatt

SEQ ID NO: 2465 - DNA, 50 bp, Artificial
  Synthetic
gcatcgcttcaatctgcgcttgcaaaacagccaatggagttttcaattca

SEQ ID NO: 2466 - DNA, 50 bp, Artificial
  Synthetic
ctccaacttgaacattgacagtttgtccaacagctttaccttcacatgct

SEQ ID NO: 2467 - DNA, 50 bp, Artificial
  Synthetic
ggctacgccactaacaagaccacctggttgtacgttgacttgagcagatg

SEQ ID NO: 2468 - DNA, 50 bp, Artificial
  Synthetic
caccgtgaataatggttgagcatttactacgtgcacctgtattggcattt

SEQ ID NO: 2469 - DNA, 50 bp, Artificial
  Synthetic
gcagcagaaacttgctgtacttgtccgctattgaccaaatcgctaataga

SEQ ID NO: 2470 - DNA, 50 bp, Artificial
  Synthetic
gatttcacgttcgtttctgcctacatcaccgctaaggtaaaagtcagagt

SEQ ID NO: 2471 - DNA, 50 bp, Artificial
  Synthetic
tggttgcagttaaggttccatccttctgttccgtaaattttactacggct

SEQ ID NO: 2472 - DNA, 50 bp, Artificial
  Synthetic
ccgcaaaatcttcagctttctcaactttactcatgcctacacttgaacct

SEQ ID NO: 2473 - DNA, 50 bp, Artificial
  Synthetic
tcacctccacgctgtaaggtgcgtgctaaagccaaacggccatctaaata

SEQ ID NO: 2474 - DNA, 50 bp, Artificial
  Synthetic
cgcgaataattttttgctcaccgtctacacctgacagttgcttattcaac

SEQ ID NO: 2475 - DNA, 50 bp, Artificial
  Synthetic
gcaacaatgcgggctttgtgagcacatgaacgataaacagcctctgctaa

SEQ ID NO: 2476 - DNA, 50 bp, Artificial
  Synthetic
aggagtgatgcttttgcattttctaacgttgcacggttcgttctagagtc

SEQ ID NO: 2477 - DNA, 50 bp, Artificial
  Synthetic
ttttcatatttagggtcaatacccgtcaccataatacctgccacttgccc

SEQ ID NO: 2478 - DNA, 50 bp, Artificial
  Synthetic
ttccaataccccacttcatctggcttcactttataatggttattcccaat

SEQ ID NO: 2479 - DNA, 50 bp, Artificial
  Synthetic
cggatcgactggcaacttgggtggttgttcagttttaagattaagtgcac

SEQ ID NO: 2480 - DNA, 50 bp, Artificial
  Synthetic
agatggtggtaatgcaacccctctttgaaccgagaaacttaagccatttg

SEQ ID NO: 2481 - DNA, 50 bp, Artificial
  Synthetic
gtagtacggcggtcatcgatcgggaagttaaagtagggaactgctagaac

SEQ ID NO: 2482 - DNA, 50 bp, Artificial
  Synthetic
caatcgtttgtccttcaccgcgtgcaatacctttatcagcacttatttgt

SEQ ID NO: 2483 - DNA, 50 bp, Artificial
  Synthetic
cactgctttctagccaaccaattgccgacatactatgcatcatcgcatca

SEQ ID NO: 2484 - DNA, 50 bp, Artificial
  Synthetic
ggttgtgcctaaggcaaatttaacacccgcttcttcaagattctgctgga

SEQ ID NO: 2485 - DNA, 50 bp, Artificial
  Synthetic
aacgactgcccctgcttcttgtaaaacgttagccacttcgatattcgact

SEQ ID NO: 2486 - DNA, 50 bp, Artificial
  Synthetic
ttccggcacagcccaaactgcaattgctacaacaataatcacccattgta

SEQ ID NO: 2487 - DNA, 50 bp, Artificial
  Synthetic
ttaccccacggttcaacgtgatataaccggcaattgattcaccatgaact

SEQ ID NO: 2488 - DNA, 50 bp, Artificial
  Synthetic
cgaccaccgcataccagacacttattcctaagcggtcagaaagcatggct

SEQ ID NO: 2489 - DNA, 50 bp, Artificial
  Synthetic
gtaagcacgttttaattctgcaacgaagccatcttttgccaattgctgca

SEQ ID NO: 2490 - DNA, 50 bp, Artificial
  Synthetic
acatcatggttgaaccagtgaagtaatggcgcatacgacgggtgttatct

SEQ ID NO: 2491 - DNA, 50 bp, Artificial
  Synthetic
ctggttttggcacagaaactcgctgaggcattccatcacgactcacttca

SEQ ID NO: 2492 - DNA, 50 bp, Artificial
  Synthetic
gtggtaaaatgagggttagaaattcaggtaaacgatatccaatgatgcta

SEQ ID NO: 2493 - DNA, 50 bp, Artificial
  Synthetic
ggcattaagcgcaccgtcacgtaaacctttttgatccatgctgataaacc

SEQ ID NO: 2494 - DNA, 50 bp, Artificial
  Synthetic
cgggatcccccatgtcgttacaccaccactaaaggaactcatcaaaaatt

SEQ ID NO: 2495 - DNA, 50 bp, Artificial
  Synthetic
gtgtggaagacctgctgtaccaaacatgagtgctaagccaagagataagg

SEQ ID NO: 2496 - DNA, 50 bp, Artificial
  Synthetic
aactacagggccggtgttgtagataatactgcctgagccaacaaagagag

SEQ ID NO: 2497 - DNA, 50 bp, Artificial
  Synthetic
gattttcattggttgtattcggtacatacggttgagttgaaccacgtcca

SEQ ID NO: 2498 - DNA, 50 bp, Artificial
  Synthetic
cctaaagtttgtactacagcatctttaaaaccagctttgtcgagagcctg

SEQ ID NO: 2499 - DNA, 50 bp, Artificial
  Synthetic
ggcttcaccaagcatcgttgtatcattatatgaatcacctgctgcaatca

SEQ ID NO: 2500 - DNA, 50 bp, Artificial
  Synthetic
gcaattaagccaccaatggcatatcctaaaataatggatggtcccgcaga

SEQ ID NO: 2501 - DNA, 50 bp, Artificial
  Synthetic
ttttcaagccactgattcatacatcctaatgtcggccctactcccacacg

SEQ ID NO: 2502 - DNA, 50 bp, Artificial
  Synthetic
cagcagtaagtgcattcatatcgaatgtttcaccacttgcagttttacgg

SEQ ID NO: 2503 - DNA, 50 bp, Artificial
  Synthetic
aacagaattgctgtaaccactaaaccaaatatcagcgtggtgtaacctaa

SEQ ID NO: 2504 - DNA, 50 bp, Artificial
  Synthetic
atggaatgatttgaccaaccacacctagtggttcatggaaatggtaggca

SEQ ID NO: 2505 - DNA, 50 bp, Artificial
  Synthetic
taagccaatcccttttgcacagtcatgagatgagccaccgcctaacgaca

SEQ ID NO: 2506 - DNA, 50 bp, Artificial; identical to SEQ ID NO: 2416
  Synthetic

SEQ ID NO: 2507 - DNA, 50 bp, Artificial
  Synthetic
ataatttgagttgctttagcagagcgttgtttcaaggcaccgtctgtgcg

SEQ ID NO: 2508 - DNA, 50 bp, Artificial; identical to SEQ ID NO: 2417
  Synthetic

SEQ ID NO: 2509 - DNA, 50 bp, Artificial
  Synthetic
caatacgagttgtagtttcataacctaggtatgggttaagtgcagtcaca

SEQ ID NO: 2510 - DNA, 50 bp, Artificial
  Synthetic
gaacttctgcaatcgcattggcataagttttaccactttcacggcaaagt

SEQ ID NO: 2511 - DNA, 50 bp, Artificial
  Synthetic
gagaagaactactaagttgttgagctgttggtaatgctaggtctagcgcc

SEQ ID NO: 2512 - DNA, 50 bp, Artificial
  Synthetic
ccatggggtcagattcattacaccactacataacaacataagtgctgtca

SEQ ID NO: 2513 - DNA, 50 bp, Artificial
  Synthetic
ttgctgtaagtactggacggcgccagaacaaaccacggtagtctgcaagg

SEQ ID NO: 2514 - DNA, 50 bp, Artificial
  Synthetic
atcaagatacccgccaagtctacagaacccgctgtaggtgcttgagcatg

SEQ ID NO: 2515 - DNA, 50 bp, Artificial
  Synthetic
aggctgagcatcacgcgagctaataagcggtgaaccacattcgctacaaa

SEQ ID NO: 2516 - DNA, 50 bp, Artificial
  Synthetic
taatattggtggtttcggttaggatggctggtgagctgacttgcaaacga

SEQ ID NO: 2517 - DNA, 50 bp, Artificial
  Synthetic
agaagccactaaaaggtggtaagcctgcgagcatcatggcaatcaggaaa

SEQ ID NO: 2518 - DNA, 50 bp, Artificial
  Synthetic
aaatttccatgagtggagcctcatagcgttgtttgatgtcttgcacatca

SEQ ID NO: 2519 - DNA, 50 bp, Artificial
  Synthetic
gtgtgagctgaacatccagcatcatattggcatctagtaaaagattggcc

SEQ ID NO: 2520 - DNA, 50 bp, Artificial
  Synthetic
cttcgattgcttgatcttttttgcttgcaattaaagcttctgcttcttct

SEQ ID NO: 2521 - DNA, 50 bp, Artificial
  Synthetic
aggccaatttcttttgcgtactgttcaaccaatgccacttgagcatcttc

SEQ ID NO: 2522 - DNA, 50 bp, Artificial
  Synthetic
cgagcaagtgagcaacttcttcaaactcgctacctgccgcaaggtcaaga

SEQ ID NO: 2523 - DNA, 50 bp, Artificial
  Synthetic
gtttcatacacagtttcggctgccttgttcatggcacggaaagcagaaag

SEQ ID NO: 2524 - DNA, 50 bp, Artificial
  Synthetic
tgcctgcaattgattttgcagcttgtggattctcaagtaagtaagcagag

SEQ ID NO: 2525 - DNA, 50 bp, Artificial
  Synthetic
taactatatgtgactggcatttcaaaagtgacttgaactccaaaacggac

SEQ ID NO: 2526 - DNA, 50 bp, Artificial
  Synthetic
caccaagactactgccgactaaagccacctcttgtaaagactcaatcagc

SEQ ID NO: 2527 - DNA, 50 bp, Artificial
  Synthetic
actgtggttcttggaacttaagcgataaaatatagttcacgccatcccaa

SEQ ID NO: 2528 - DNA, 50 bp, Artificial
  Synthetic
ctgtgttgcagccagtgggagtaacgtacggttaatcagtgttgatttac

SEQ ID NO: 2529 - DNA, 50 bp, Artificial
  Synthetic
agtcaacatttggatggtaacgaacaccacctttaccaggaccacgagac

SEQ ID NO: 2530 - DNA, 50 bp, Artificial
  Synthetic
acccaatctcagtcggcatctctaaattaatactcatccggtcagcatat

SEQ ID NO: 2531 - DNA, 50 bp, Artificial
  Synthetic
tacgttgctcatcataaatgagccaacgctgatcttgataacgccgttta

SEQ ID NO: 2532 - DNA, 50 bp, Artificial
  Synthetic
cctagtgactgtaaggctgcttctgcttctgcaacaggtgagttcgaaac

SEQ ID NO: 2533 - DNA, 50 bp, Artificial
  Synthetic
taataatttcataatgatgtttggcaaaagctgtagtgacttcatcaacc

SEQ ID NO: 2534 - DNA, 50 bp, Artificial
  Synthetic
tatctgcatattgttcaggtttcggacgtacttggttgtgtacagcatcg

SEQ ID NO: 2535 - DNA, 50 bp, Artificial
  Synthetic
ttagatcatttgaaccacagtacatacaacgtttaaccgagtaaaagttt

SEQ ID NO: 2536 - DNA, 50 bp, Artificial
  Synthetic
actttgtagctgtttgactaattgatagccgattccccatacctctttga

SEQ ID NO: 2537 - DNA, 50 bp, Artificial
  Synthetic
atttctcgataagctctgctttagagtaatctcggcgagtgagtaaagca

SEQ ID NO: 2538 - DNA, 50 bp, Artificial
  Synthetic
cgtttagcattacccgtaattttacgaagtgcctggctcataagacgtgc

SEQ ID NO: 2539 - DNA, 50 bp, Artificial
  Synthetic
ctccgtcacgggtattacaccgaacttacatttaagagcagcttcttgaa

SEQ ID NO: 2540 - DNA, 50 bp, Artificial
  Synthetic
tttaaatcgagtgcttgctcaatatcgtcttgcgctggtgatgggaaacc

SEQ ID NO: 2541 - DNA, 50 bp, Artificial
  Synthetic
ccctgccctcgcgcttttacctcaacaaaaatcaattcgttaccgcgttt

SEQ ID NO: 2542 - DNA, 50 bp, Artificial
  Synthetic
aaaggtatctttcacttcacgtaccacatccagatatggcatgcccggtt

SEQ ID NO: 2543 - DNA, 50 bp, Artificial
  Synthetic
ataagagttcaaggcacgtacaggtgtccagtcattacctaaaccacctg

SEQ ID NO: 2544 - DNA, 50 bp, Artificial
  Synthetic
gacttccaaagtgcgatatcgtggttcatgttcacttcttgaggcatcca

SEQ ID NO: 2545 - DNA, 50 bp, Artificial
  Synthetic
attcctcaactaaatcatctaaaaatgcaattcgcacttgcaaatcttca

SEQ ID NO: 2546 - DNA, 50 bp, Artificial
  Synthetic
ttggcaaggcatagctgcgccctgtttcatcaaggaagtaaactcgctga

SEQ ID NO: 2547 - DNA, 50 bp, Artificial
  Synthetic
gtcaccacgtgcttttagaataggaaggatgccatatttctgatagccga

SEQ ID NO: 2548 - DNA, 50 bp, Artificial
  Synthetic
tctccagtaacgccaacatcgagtgagccaacagctaaggcttctaaaat

SEQ ID NO: 2549 - DNA, 50 bp, Artificial
  Synthetic
ccatttgtggcccccaatatttaactttaagcgcttgagtatcctgaata

SEQ ID NO: 2550 - DNA, 50 bp, Artificial
  Synthetic
aacgagggccgtggttgtaccgtgttttaagagttcctgaacaaagaact

SEQ ID NO: 2551 - DNA, 50 bp, Artificial
  Synthetic
tttaacgtctcgacttgaagtggtaccgccgccatagctagacactgtca

SEQ ID NO: 2552 - DNA, 50 bp, Artificial
  Synthetic
gaatacctaaaccacggcgataaagcgtcttgaaacggccaatattagaa

SEQ ID NO: 2553 - DNA, 50 bp, Artificial
  Synthetic
gtagtgctctgaaggcttggttttaatctggaagttgacttgatggtaat

SEQ ID NO: 2554 - DNA, 50 bp, Artificial
  Synthetic
caaacaattcaatgatttcttcattacgcattcgaatacacccatgtgac

SEQ ID NO: 2555 - DNA, 50 bp, Artificial
  Synthetic
aaattgcatactgcccataattgcactggctgttcctgcacgagcacctt

SEQ ID NO: 2556 - DNA, 50 bp, Artificial
  Synthetic
tttttaatctgacccacttgtttagcaccggcatttcgctctgcctgtaa

SEQ ID NO: 2557 - DNA, 50 bp, Artificial; identical to SEQ ID NO: 2477
  Synthetic

SEQ ID NO: 2558 - DNA, 50 bp, Artificial
  Synthetic
cgattggcaatacgcggtgttccgcgtgaacggcgtgcaacttcttctgc

SEQ ID NO: 2559 - DNA, 50 bp, Artificial; identical to SEQ ID NO: 2532
  Synthetic

SEQ ID NO: 2560 - DNA, 50 bp, Artificial
  Synthetic
accaacggcgctgcaaaatattacgtgaacggtcatctagctggttcatt

SEQ ID NO: 2561 - DNA, 50 bp, Artificial
  Synthetic
aacatatcacaaacttcacgcacagctccacggccacccatcgcctgtgt

SEQ ID NO: 2562 - DNA, 50 bp, Artificial; identical to SEQ ID NO: 2398
  Synthetic

SEQ ID NO: 2563 - DNA, 50 bp, Artificial
  Synthetic
gcctgcaacacccaagaaataccaatgacttttagctaactcaccatatt

SEQ ID NO: 2564 - DNA, 50 bp, Artificial
  Synthetic
cagccttcagcaaagagagtgtatttagcgtgaagttcataacccggagt

SEQ ID NO: 2565 - DNA, 50 bp, Artificial
  Synthetic
cagtagaatactttacggtttggttctaagtgacgttgttgtagctcttt

SEQ ID NO: 2566 - DNA, 50 bp, Artificial
  Synthetic
ttaattcgatagaaacatcatgaccacggaagtcaaaacgtgttgcaatc

SEQ ID NO: 2567 - DNA, 50 bp, Artificial
  Synthetic
cgtgctcgctaatgcctgttgggtatattcattaccattacggcgtaaaa

SEQ ID NO: 2568 - DNA, 50 bp, Artificial
  Synthetic
ggctcgcaagaccagttacaaacgcttggaaaggtgtaaggccatgctca

SEQ ID NO: 2569 - DNA, 50 bp, Artificial
  Synthetic
gttgttgctgtacttgacgttgttcttgaactaatgcttttaatgcttca

SEQ ID NO: 2570 - DNA, 50 bp, Artificial
  Synthetic
acgtcaaggaagtttgcaggctgaccaccataaagtttaatgatgtccat

SEQ ID NO: 2571 - DNA, 50 bp, Artificial
  Synthetic
gtttcagcatccatgtttaatgtagttttggcatttgaagacaaaccttt

SEQ ID NO: 2572 - DNA, 50 bp, Artificial
  Synthetic
ttaagcagtaaccagcttcatcagtatggcctgtttttaagccatcaaca

SEQ ID NO: 2573 - DNA, 50 bp, Artificial; identical to SEQ ID NO: 2417
  Synthetic

SEQ ID NO: 2574 - DNA, 50 bp, Artificial
  Synthetic
ccaataaagtcaggatcttcgttacccactaatgcccattgtgcagcaat

SEQ ID NO: 2575 - DNA, 50 bp, Artificial
  Synthetic
gtatagatcgggtcatttttgttcgcttcagcaacacccaataagttgac

SEQ ID NO: 2576 - DNA, 50 bp, Artificial
  Synthetic
tgactcgcggttgatttccacagactcaagaatactcattaaggtttgcc

SEQ ID NO: 2577 - DNA, 50 bp, Artificial
  Synthetic
ccaaagttcaggacgttggtttttaggatcccaacgatgtttactatcac

SEQ ID NO: 2578 - DNA, 50 bp, Artificial
  Synthetic
aaccagttctttcctttcttcttttctttttctctaataatccccatcat

SEQ ID NO: 2579 - DNA, 50 bp, Artificial
  Synthetic
taagtactggacggcgccagaacaaaccacggtagtctgcaaggctttgc

SEQ ID NO: 2580 - DNA, 50 bp, Artificial
  Synthetic
tgttttaatcaagatacccgccaagtctacagaacccgctgtaggtgctt

SEQ ID NO: 2581 - DNA, 50 bp, Artificial
  Synthetic
agctgttaccattgttgctgcgtggattaatgcagaaacaggtgtaggac

SEQ ID NO: 2582 - DNA, 50 bp, Artificial
  Synthetic
cacgcctctgccgcagcaagggttaaaatcagaatgaacatgacttgtcc

SEQ ID NO: 2583 - DNA, 50 bp, Artificial
  Synthetic
cggataccaacgtccgtcttctttttcagctttttgcagtgaaatacagc

SEQ ID NO: 2584 - DNA, 50 bp, Artificial
  Synthetic
ttgttatttgatgaccaaccaccgaataacactgcataaaccgcaatacc

SEQ ID NO: 2585 - DNA, 50 bp, Artificial
  Synthetic
cgttgtgcacgaccttcttggcttacgacagtaccatcaccttcggcaaa

SEQ ID NO: 2586 - DNA, 50 bp, Artificial
  Synthetic
cgtcccaatgttttgcaagttccgcaaatgcattatcaatttcagcatca

SEQ ID NO: 2587 - DNA, 50 bp, Artificial
  Synthetic
aattgtatgttcacctactataggcataatggtaaaagaaagtagagagg

SEQ ID NO: 2588 - DNA, 50 bp, Artificial
  Synthetic
caaaaagataactaaaaggctgtttggttacactcaccttatgactaggc

SEQ ID NO: 2589 - DNA, 50 bp, Artificial
  Synthetic
taactctataaagtgattaccgccgcctaaagtgcccaactgtttttgcc

SEQ ID NO: 2590 - DNA, 50 bp, Artificial
  Synthetic
ccatagcagctacattttgcccaagtggcgtgagggaataatcgacacga

SEQ ID NO: 2591 - DNA, 50 bp, Artificial
  Synthetic
gtaattcttcacccgcatcgccaatgagtttaattggatagtccattgga

SEQ ID NO: 2592 - DNA, 50 bp, Artificial
  Synthetic
gacagctttagtttgagcccatgcagcttctaattcagcaaaacgaactt

SEQ ID NO: 2593 - DNA, 50 bp, Artificial
  Synthetic
atcgacttctccttgttgcacagcatttaacaaatatcctgtcgggtgag

SEQ ID NO: 2594 - DNA, 50 bp, Artificial
  Synthetic
ggtgtcgcaataatcttttggcccacttgaggtgctttgaaatattgcaa

SEQ ID NO: 2595 - DNA, 50 bp, Artificial
  Synthetic
gccatttgtaccgcccatgtttttaccaacggtgtaacccgcgccaccgc

SEQ ID NO: 2596 - DNA, 50 bp, Artificial; identical to SEQ ID NO: 2503
  Synthetic

SEQ ID NO: 2597 - DNA, 50 bp, Artificial
  Synthetic
gtcatctgcatcatatatgcaatcattggaacagtcgcaatcagcaaacc

SEQ ID NO: 2598 - DNA, 50 bp, Artificial
  Synthetic
caccgagtgcacccatcggtaaaatcaaacccgccataatcagcgaataa

SEQ ID NO: 2599 - DNA, 50 bp, Artificial
  Synthetic
atcacctgccatccacctatttttttcgaaagtactccgccttctgcata

SEQ ID NO: 2600 - DNA, 50 bp, Artificial; identical to SEQ ID NO: 2442
  Synthetic

SEQ ID NO: 2601 - DNA, 50 bp, Artificial; identical to SEQ ID NO: 2443
  Synthetic

SEQ ID NO: 2602 - DNA, 50 bp, Artificial; identical to SEQ ID NO: 2444
  Synthetic

SEQ ID NO: 2603 - DNA, 50 bp, Artificial
  Synthetic
aactgcatgccaaaatgcttcaaaaccagatttgcggtaacgctcggctt

SEQ ID NO: 2604 - DNA, 50 bp, Artificial
  Synthetic
aagtgctgcacccacaccaaaaatactaaaagtggcccacaactcaccta

SEQ ID NO: 2605 - DNA, 50 bp, Artificial
  Synthetic
ttaagtaaaagttatcaagatgatctggttcaataataacatctgcgcca

SEQ ID NO: 2606 - DNA, 50 bp, Artificial
  Synthetic
cctgtacccgataaaagagctgaatctgtgccagttacattttggcgtaa

SEQ ID NO: 2607 - DNA, 50 bp, Artificial
  Synthetic
tctaagccgtctaagtaaactaagcttttaggatctacaaaaaccttaac

SEQ ID NO: 2608 - DNA, 50 bp, Artificial
  Synthetic
tgtcgcttcatcaagttgttcacgaagttctaaagcggattgtagaaatt

SEQ ID NO: 2609 - DNA, 50 bp, Artificial
  Synthetic
gcttcacgagcagaaacggtgagtaagccatctgcatcaacttggaaagt

SEQ ID NO: 2610 - DNA, 50 bp, Artificial
  Synthetic
tattcctcatccgtttactcataaagaaactaataaagaacatcactaca

SEQ ID NO: 2611 - DNA, 50 bp, Artificial
  Synthetic
gtgtcaagcttcctaatgttccggcttgcacaccagttaaatgaaactct

SEQ ID NO: 2612 - DNA, 50 bp, Artificial
  Synthetic
gtttagggcactgggcaatcgcgttccaataacgttctgtatgacgcaat

SEQ ID NO: 2613 - DNA, 50 bp, Artificial
  Synthetic
gtccccattttgaagtggaataggccaatcgatatggatagcctaagcgt

SEQ ID NO: 2614 - DNA, 50 bp, Artificial
  Synthetic
tgagtagatcatcaattggcatatctcttagtaactttttactgagctgt

SEQ ID NO: 2615 - DNA, 50 bp, Artificial
  Synthetic
gctgaaatttgcttgagttaggtacttgtttgatataacccaaacgcgac

SEQ ID NO: 2616 - DNA, 50 bp, Artificial
  Synthetic
gaaaagccggtgaagtttgtccaagttcaaatgcaactctgacttcctct

SEQ ID NO: 2617 - DNA, 50 bp, Artificial
  Synthetic
actgactacaatttgaaccttcagaagcattacctaattgcttttcagaa

SEQ ID NO: 2618 - DNA, 50 bp, Artificial
  Synthetic
cgcatcatagattttaggtcggtcagttttaaacttttctacatccagtg

SEQ ID NO: 2619 - DNA, 50 bp, Artificial
  Synthetic
gttttaggaagagcttttagtttctttgcaagttcaacaagggagtcact

SEQ ID NO: 2620 - DNA, 50 bp, Artificial
  Synthetic
aaccaaatacccattcaatgccgttaatatccgctaaatgccctagcccc

SEQ ID NO: 2621 - DNA, 50 bp, Artificial
  Synthetic
tagacgatgttcttctacacgtggctgccattcttcggtcaaataatcat

SEQ ID NO: 2622 - DNA, 50 bp, Artificial
  Synthetic
gctgttccatttaaatcttgtggaagttgctggcgttgaatcgctcttcc

SEQ ID NO: 2623 - DNA, 50 bp, Artificial
  Synthetic
cggtgcgggttgttcatttgcatcgataccaaaccagatgaagattgcac

SEQ ID NO: 2624 - DNA, 50 bp, Artificial
  Synthetic
cttgttcaactgtgtgttgccctaagttaagcatcatcacaacgaatacg

SEQ ID NO: 2625 - DNA, 50 bp, Artificial
  Synthetic
cagtctggttatcttgaaccaatacttccgttacaagtcctgctacatct

SEQ ID NO: 2626 - DNA, 50 bp, Artificial
  Synthetic
tgggtaatgcaatccagccttgtgcaatccatttgttggttaagggactt

SEQ ID NO: 2627 - DNA, 50 bp, Artificial
  Synthetic
gctgatgttcagaagccgaatcatttaagttcaagaaatcattttcaaac

SEQ ID NO: 2628 - DNA, 50 bp, Artificial
  Synthetic
gcgcttttacaaggtagtcaaattcacctgaaatgaggtgacattcgagt

SEQ ID NO: 2629 - DNA, 50 bp, Artificial
  Synthetic
atagttgagctgcacgagacaccaagccttgtactttaatacctaaagcg

SEQ ID NO: 2630 - DNA, 50 bp, Artificial
  Synthetic
ctgcgggaactgccaggcttcctgattgatacgccgcgcccacagcacct

SEQ ID NO: 2631 - DNA, 50 bp, Artificial
  Synthetic
atgcagccctcggcgcggtcgtcgtccaggctcggccagcgggtgttctg

SEQ ID NO: 2632 - DNA, 50 bp, Artificial
  Synthetic
cgcaggtcgcggtcgtcgacgccacggtaggcgcggccctgctgggcgag

SEQ ID NO: 2633 - DNA, 50 bp, Artificial
  Synthetic
tgcttggtcaggtactcggcgagacggttggcgccgtgcttggtacgggt

SEQ ID NO: 2634 - DNA, 50 bp, Artificial
  Synthetic
tgctggttgagcaggcgctggcagcggaacagcacgtcgctgtggaagaa

SEQ ID NO: 2635 - DNA, 50 bp, Artificial
  Synthetic
gcgtgtcggacttcttcaggcgctcggacttgtgcgccaccgccagcagg

SEQ ID NO: 2636 - DNA, 50 bp, Artificial
  Synthetic
agggccgggtagctcgccgggcgtacctcggaggccttggggatcggcac

SEQ ID NO: 2637 - DNA, 50 bp, Artificial
  Synthetic
ttcgccgagggtggcgtcggccggcttgtccatgaccgccttcagctcgg

SEQ ID NO: 2638 - DNA, 50 bp, Artificial
  Synthetic
ccgatctcgcgggcgatggcgaccttctcgtcgctggagaagggtagcgc

SEQ ID NO: 2639 - DNA, 50 bp, Artificial
  Synthetic
gatcaccttgaccgcagccgaggactgcacggtagcgatggcgttaccgg

SEQ ID NO: 2640 - DNA, 50 bp, Artificial
  Synthetic
tctgctgcttgagcaggaacaccgcctggctttcctgttcgctgaagatc

SEQ ID NO: 2641 - DNA, 50 bp, Artificial
  Synthetic
tggcgtcctccgttccttcgacttcccattcaccggcccagtcctcgccg

SEQ ID NO: 2642 - DNA, 50 bp, Artificial
  Synthetic
gaacaggctcttgtcgaagaactccggggcgttcaggccatgcaggatcg

SEQ ID NO: 2643 - DNA, 50 bp, Artificial
  Synthetic
gctgccgtccaccgtatggttggcgtgctgctcgaagggcagggtgatgt

SEQ ID NO: 2644 - DNA, 50 bp, Artificial
  Synthetic
aggtttccggctgcgacgccaactccaccagttcagccagctcggggctg

SEQ ID NO: 2645 - DNA, 50 bp, Artificial
  Synthetic
tggcgatgatgttgtgcagggtcatgccgtacttgtccatcaacgcctgc

SEQ ID NO: 2646 - DNA, 50 bp, Artificial
  Synthetic
ctccatgtcgttgaccatcgggatcatcggcgagcagagcacgcccaccg

SEQ ID NO: 2647 - DNA, 50 bp, Artificial
  Synthetic
ttgatcttctcttccagttccaccgggctgtcgatgcgcaggttgtgcac

SEQ ID NO: 2648 - DNA, 50 bp, Artificial
  Synthetic
tggaccccggtggtggtctcttcggtgatgccgtggatgcgctcgagcat

SEQ ID NO: 2649 - DNA, 50 bp, Artificial
  Synthetic
ttctgcagcggggagcaatcccagccgccggtggccgataccttgcagtc

SEQ ID NO: 2650 - DNA, 50 bp, Artificial
  Synthetic
gccgcttcggcgagggtttcctgcttcaggttgcgcatcgccatggcctg

SEQ ID NO: 2651 - DNA, 50 bp, Artificial
  Synthetic
agtcttccgcggactcgcggatggccagcgccgggcgcgccgccaggagg

SEQ ID NO: 2652 - DNA, 50 bp, Artificial
  Synthetic
gctccaccaccacgttcttcagttcctcgggtaggcgatttaccaggcga

SEQ ID NO: 2653 - DNA, 50 bp, Artificial
  Synthetic
cgagaccggccttgtcggcacgccacatctcgccgctgacgccgcccagc

SEQ ID NO: 2654 - DNA, 50 bp, Artificial
  Synthetic
gggcctcctccagttgcggacgatagtggcgggcaaccaggccgccgccg

SEQ ID NO: 2655 - DNA, 50 bp, Artificial
  Synthetic
ggggtcagcgccaggcggtccagcatcgccggctccaggccattggcgcg

SEQ ID NO: 2656 - DNA, 50 bp, Artificial
  Synthetic
gtagtacgacttgatcacggcgatgccgcgacccatcacgtcgcgccagg

SEQ ID NO: 2657 - DNA, 50 bp, Artificial
  Synthetic
tcgcgcccgcgcagcaggtgccaggcggccgaggcgccgacgaagaaggc

SEQ ID NO: 2658 - DNA, 50 bp, Artificial
  Synthetic
gatcgagcttgtagttcaggccgatctcggtggagttgttccaggaagtg

SEQ ID NO: 2659 - DNA, 50 bp, Artificial
  Synthetic
cccgagggtgagttgcagcgacaaccggccgggattcggcgaggtcgagg

SEQ ID NO: 2660 - DNA, 50 bp, Artificial
  Synthetic
agggtatcctgcttgttcaacagcagggcgaactggttgatgccctgggg

SEQ ID NO: 2661 - DNA, 50 bp, Artificial
  Synthetic
cttgcccacgcccatcaggtagcgcggcttgtcggccggcatctgcggcg

SEQ ID NO: 2662 - DNA, 50 bp, Artificial
  Synthetic
gcggccttctggaacttcagctcgacgttgtcggaaacctcgacgacgac

SEQ ID NO: 2663 - DNA, 50 bp, Artificial
  Synthetic
cgaccgcggctggcggtgaattcttcctggcgtaccgggtcgaggaccac

SEQ ID NO: 2664 - DNA, 50 bp, Artificial
  Synthetic
cagcgggatgttcagttcgatgccgcgggtcaggcgagttttcaaactca

SEQ ID NO: 2665 - DNA, 50 bp, Artificial
  Synthetic
gctgatcgggttgcgctcgccgagctgccagcagcggtcgatcacttcct

SEQ ID NO: 2666 - DNA, 50 bp, Artificial
  Synthetic
ttgttgacgaagtccttgaccaccggcagggccacgtcggcctcgagcag

SEQ ID NO: 2667 - DNA, 50 bp, Artificial
  Synthetic
gtcgacggacagacgcacttcgccaccagtcgcaaccgggttgaagaaac

SEQ ID NO: 2668 - DNA, 50 bp, Artificial
  Synthetic
ccttcaggccttccagctggtgccagtagtactcaccttcctcgagagag

SEQ ID NO: 2669 - DNA, 50 bp, Artificial
  Synthetic
ctcggcggaatctgcatgacccaatgcaccgggcagcaaccgcgtcactg

SEQ ID NO: 2670 - DNA, 50 bp, Artificial
  Synthetic
cagcgcagtcccgccgaacagggtgttgtggtgattggtggtgggcggga

SEQ ID NO: 2671 - DNA, 50 bp, Artificial
  Synthetic
gtaccagcgcggccacggagtcgacgatgatcacgtcgaccgcgttggag

SEQ ID NO: 2672 - DNA, 50 bp, Artificial
  Synthetic
acggatgcgcaacggcccatggccgctacgggcgcgactggcgatgaagc

SEQ ID NO: 2673 - DNA, 50 bp, Artificial
  Synthetic
acggcgccgatgccgcccttgtccaccggggtgttgcgccaggcgttgtg

SEQ ID NO: 2674 - DNA, 50 bp, Artificial
  Synthetic
cgggtcggtcacgaaggcgatcacggtggtaccgtgcttcatcggcccgg

SEQ ID NO: 2675 - DNA, 50 bp, Artificial
  Synthetic
cacctggggaccgtcgagcaggtagagcgcgtggtagggcttgccggcct

SEQ ID NO: 2676 - DNA, 50 bp, Artificial
  Synthetic
ttcagcgacggcaccgccttctgcagcacctcggccagcgtttccgccag

SEQ ID NO: 2677 - DNA, 50 bp, Artificial
  Synthetic
atcgcgaatggccttggccacctcggccgccgactcgtgttcgagccaga

SEQ ID NO: 2678 - DNA, 50 bp, Artificial
  Synthetic
cgaacatccaggccaccgcgccggcgactatccaggtaagcagggacaag

SEQ ID NO: 2679 - DNA, 50 bp, Artificial
  Synthetic
cattggggtcgcggaaaccgacgatgccatggccggtgatcatcgccacc

SEQ ID NO: 2680 - DNA, 50 bp, Artificial
  Synthetic
tcgaggatgccgatgtccttcatgctcatgccgcgcacgcgcaacaggta

SEQ ID NO: 2681 - DNA, 50 bp, Artificial
  Synthetic
tacgctgaacggattaggacgcttgtcctcgacttcgctcgactccggct

SEQ ID NO: 2682 - DNA, 50 bp, Artificial
  Synthetic
agccgtccggggatacgtggtggcgcaggtggacttcaccggtgctcttt

SEQ ID NO: 2683 - DNA, 50 bp, Artificial
  Synthetic
ggaagcggtcgatggtcgcgcgcagggtgctggcatcgcggcgcacgtac

SEQ ID NO: 2684 - DNA, 50 bp, Artificial
  Synthetic
gctcgacttccagcagacgctggatcgaaccggccttctggtcggcatgg

SEQ ID NO: 2685 - DNA, 50 bp, Artificial
  Synthetic
ctccaggtccgggaagtccttcttcaattgcgccgcgacctcgtagcgca

SEQ ID NO: 2686 - DNA, 50 bp, Artificial
  Synthetic
  misc_feature (1)..(18): n is a, c, g, or t
nnnnnnnnnnnnnnnnnnttcgggtagggaaccttttcatccagtttggc

SEQ ID NO: 2687 - DNA, 50 bp, Artificial
  Synthetic
tgctcgcggattttaaagccgatcttctcgtttctcaagtcggacttggc

SEQ ID NO: 2688 - DNA, 50 bp, Artificial
  Synthetic
tagttttacctggtaatccccttcttccgtccctggacgaaacttgattt

SEQ ID NO: 2689 - DNA, 50 bp, Artificial
  Synthetic
tcttcgaagagttggccccacttgtcgaagacgtccttgtagtagacgct

SEQ ID NO: 2690 - DNA, 50 bp, Artificial
  Synthetic
ccacgtcgccgggcttcttcaccgggctgggcacgccttcgaaccagcgt

SEQ ID NO: 2691 - DNA, 50 bp, Artificial
  Synthetic
tgtcgccggtgaggatgcggatgtagttcttgcgcattttgccggagatg

SEQ ID NO: 2692 - DNA, 50 bp, Artificial
  Synthetic
ctgcggttcgccgggcaacaacgcgcgtgatgaacagaccgcgatacagg

SEQ ID NO: 2693 - DNA, 50 bp, Artificial
  Synthetic
cccaggacaccagcaggtagccgaggcgggtcagggcgttgtagtcacgg

SEQ ID NO: 2694 - DNA, 50 bp, Artificial
  Synthetic
ccggtttatgcgtatcaacaatcactacggttgtcttagatgtcatcata

SEQ ID NO: 2695 - DNA, 50 bp, Artificial
  Synthetic
cgccaacttcaacttcaactggatatggaatgtacgaatccgcactgcct

SEQ ID NO: 2696 - DNA, 50 bp, Artificial
  Synthetic
cctcttcagtagcaggcggttgcattgattctttgatatatgcaatttcc

SEQ ID NO: 2697 - DNA, 50 bp, Artificial
  Synthetic
ctgtccttcgctaccaattacaatagccaatgacatgtccgcttctagat

SEQ ID NO: 2698 - DNA, 50 bp, Artificial
  Synthetic
attttcttttaaatctctccacatttcgcgagatgatattctatatgcac

SEQ ID NO: 2699 - DNA, 50 bp, Artificial
  Synthetic
atactaagaaaaaggctgttgtcgcaaaggcgataacgattgctgttaaa

SEQ ID NO: 2700 - DNA, 50 bp, Artificial
  Synthetic
tacttgatcaacgttacgttttaaaggtgcacgctcttcgatttctttaa

SEQ ID NO: 2701 - DNA, 50 bp, Artificial
  Synthetic
ctacttgtcgaatgtgttcactctcacaatttggacattgattcggtggc

SEQ ID NO: 2702 - DNA, 50 bp, Artificial
  Synthetic
atagcctggcgtccatctttttctgaatctacaatgacatgttgtaatga

SEQ ID NO: 2703 - DNA, 50 bp, Artificial
  Synthetic
tgtatttatttctgcttctatactttgaatggtatgttccgactgttcta

SEQ ID NO: 2704 - DNA, 50 bp, Artificial
  Synthetic
gctaatgatttaccactgcctagtgatgcttcaatcattgctttttcact

SEQ ID NO: 2705 - DNA, 50 bp, Artificial
  Synthetic
tcatttttatcgtaagaaatggcttttttgagataatcttctgaagtcat

SEQ ID NO: 2706 - DNA, 50 bp, Artificial
  Synthetic
ccaggtttacagaagaattcaagttccatttgttcaaattctcttgttct

SEQ ID NO: 2707 - DNA, 50 bp, Artificial
  Synthetic
tgcttcattttggcgtggaatatacgcagggtcacctgataataaataac

SEQ ID NO: 2708 - DNA, 50 bp, Artificial
  Synthetic
cagtcattgtccattgcgttaataatcctgtatcccctttcgttaaaggg

SEQ ID NO: 2709 - DNA, 50 bp, Artificial
  Synthetic
tgcgtaaagctgtagcaagttgctcaaattcatcccagctgttcactgaa

SEQ ID NO: 2710 - DNA, 50 bp, Artificial
  Synthetic
caatattagctagtggagactcaccagtccctgatggcttgatttcatct

SEQ ID NO: 2711 - DNA, 50 bp, Artificial
  Synthetic
atgatattaaattaacttgccatgttttaagtcccgattgataccattgc

SEQ ID NO: 2712 - DNA, 50 bp, Artificial
  Synthetic
taagcttgtctagtcgtctgaactacttctctgaaaagtattttctttct

SEQ ID NO: 2713 - DNA, 50 bp, Artificial
  Synthetic
ttactggtttaaccaatgcactaatcatcgtcaaaatgactagcataata

SEQ ID NO: 2714 - DNA, 50 bp, Artificial
  Synthetic
atacactttcaatcatatctttagtcgttgttttaccattagaccctgtg

SEQ ID NO: 2715 - DNA, 50 bp, Artificial
  Synthetic
acgccttttagatcttttttaagcattttaaatcctgtcacttcgacatt

SEQ ID NO: 2716 - DNA, 50 bp, Artificial
  Synthetic
tagcttcttctaatacagctaatgtaatttttttagtgtcagctctgcta

SEQ ID NO: 2717 - DNA, 50 bp, Artificial
  Synthetic
ctgttgttttatcaattccaaggccattatctgttacggcaaagtacatg

SEQ ID NO: 2718 - DNA, 50 bp, Artificial
  Synthetic
ctgcaccgatattcatatgaccaacttctgagttacccatttgtccttca

SEQ ID NO: 2719 - DNA, 50 bp, Artificial
  Synthetic
ttcttcagattcttcatagaaatcattccaagtttctctatcccaaatct

SEQ ID NO: 2720 - DNA, 50 bp, Artificial
  Synthetic
ttgtgtttggtccatacgcatgtctaatgttgcgtcatggtgataactga

SEQ ID NO: 2721 - DNA, 50 bp, Artificial
  Synthetic
tttgcttcgccattactacgcactacctttacattatcgttctcaaggct

SEQ ID NO: 2722 - DNA, 50 bp, Artificial
  Synthetic
ccttcgtttatttgcaatgcaccgaaacctaatgttgcagcaacgcctgt

SEQ ID NO: 2723 - DNA, 50 bp, Artificial
  Synthetic
cctttttcttcagaattaggtgatagtatttcccagaataatgaatggtt

SEQ ID NO: 2724 - DNA, 50 bp, Artificial
  Synthetic
aacctgttgcatctttattttcaattttagtgattcggatgtaaccacca

SEQ ID NO: 2725 - DNA, 50 bp, Artificial
  Synthetic
tccaccttgaactctgcggacgatatcaatgatgtcatctttaaatgttg

SEQ ID NO: 2726 - DNA, 50 bp, Artificial
  Synthetic
cctcttccatagttatcattctacagttttgtaaaatacctagcgagcga

SEQ ID NO: 2727 - DNA, 50 bp, Artificial
  Synthetic
ccaccttgttcttaaattcaataacgtctttgttttttccatgtaactca

SEQ ID NO: 2728 - DNA, 50 bp, Artificial
  Synthetic
acgccgcccccaattttacttaattgttttgcagttgaatcaataaagtt

SEQ ID NO: 2729 - DNA, 50 bp, Artificial
  Synthetic
ccaacttgcaatgtcttttgatactttaaattctgtttcaacccacattt

SEQ ID NO: 2730 - DNA, 50 bp, Artificial
  Synthetic
gcacatctacaagttttctaagtaattcacttctatccatttccatacca

SEQ ID NO: 2731 - DNA, 50 bp, Artificial
  Synthetic
agttgaacgtttatgaagttcagatgcaagtttcacacgttgagcctcac

SEQ ID NO: 2732 - DNA, 50 bp, Artificial
  Synthetic
tgaagtgctgcttgtttctctttttcattggcaagctcttcttgtagttc

SEQ ID NO: 2733 - DNA, 50 bp, Artificial
  Synthetic
tcttgtccttgtttaagctgttctgcacgacgtacttctagtcttactga

SEQ ID NO: 2734 - DNA, 50 bp, Artificial
  Synthetic
gtctccgtctaatataccagcctcaatcatactgtcgcctacgacgttta

SEQ ID NO: 2735 - DNA, 50 bp, Artificial
  Synthetic
gttcgctattgtttgtagggtctttatgttcgtatgctttatttatcgta

SEQ ID NO: 2736 - DNA, 50 bp, Artificial
  Synthetic
attcaaccgttccaatagttaatggtctttcagaatcagatgtctttcca

SEQ ID NO: 2737 - DNA, 50 bp, Artificial
  Synthetic
ctgacatcggctgtttaccatcagcgaaatgacttctcaaatcattttct

SEQ ID NO: 2738 - DNA, 50 bp, Artificial
  Synthetic
gatctttcaaagtatattgcttatgtacaccgccttcatcactatagcca

SEQ ID NO: 2739 - DNA, 50 bp, Artificial
  Synthetic
gcgaccatcttctttaatttctttaaccattgcacctaaagtatcaacat

SEQ ID NO: 2740 - DNA, 50 bp, Artificial
  Synthetic
ttttaaatcactattaccactgccaccattaccgccaccacaagcaccta

SEQ ID NO: 2741 - DNA, 50 bp, Artificial
  Synthetic
cctcaggtacttctgcagtaccttggttatcgtcaaggattacgaaagca

SEQ ID NO: 2742 - DNA, 50 bp, Artificial
  Synthetic
ttcaagttatgtcgctcaattagtgttttagaaccaacgggttgtccaaa

SEQ ID NO: 2743 - DNA, 50 bp, Artificial
  Synthetic
gcatcaatacgataaatggttaagcgtactgaatctacaaagccattatt

SEQ ID NO: 2744 - DNA, 50 bp, Artificial
  Synthetic
gccacatcacctatttgtggaacaaacgatggtgtgttttcatatactgt

SEQ ID NO: 2745 - DNA, 50 bp, Artificial
  Synthetic
tccatcgaccattccaatatctacgcaagacagcaacatcagggttactt

SEQ ID NO: 2746 - DNA, 50 bp, Artificial
  Synthetic
gccctcgtttcgtgccagcaccaacccaaccttttgcatcaggaaaatta

SEQ ID NO: 2747 - DNA, 50 bp, Artificial
  Synthetic
ttgaatttgattgagggtcccatgtgctattatgacctgcatatagaaca

SEQ ID NO: 2748 - DNA, 50 bp, Artificial
  Synthetic
gcgccatttgcgctaaagatgctttatttaagtccgcttcacttgcatgg

SEQ ID NO: 2749 - DNA, 50 bp, Artificial
  Synthetic
gaccaaatggtccttcagaagattgtaggatagcgcctttagaaggtgta

SEQ ID NO: 2750 - DNA, 50 bp, Artificial
  Synthetic
cagagtgtttcatcgatttaatcggttgaggattccattcgtatccttta

SEQ ID NO: 2751 - DNA, 50 bp, Artificial
  Synthetic
tgccttcgccagtataagcaggctctaaaacaagattagcctttgcacaa

SEQ ID NO: 2752 - DNA, 50 bp, Artificial
  Synthetic
atcactaaatgaatcgtcacatttaattgaaacatgctgaaacgttttgg

SEQ ID NO: 2753 - DNA, 50 bp, Artificial; identical to SEQ ID NO: 1881
  Synthetic

SEQ ID NO: 2754 - DNA, 50 bp, Artificial; identical to SEQ ID NO: 1882
  Synthetic

SEQ ID NO: 2755 - DNA, 50 bp, Artificial; identical to SEQ ID NO: 1883
  Synthetic

SEQ ID NO: 2756 - DNA, 50 bp, Artificial; identical to SEQ ID NO: 1885
  Synthetic

SEQ ID NO: 2757 - DNA, 50 bp, Artificial; identical to SEQ ID NO: 1887
  Synthetic

SEQ ID NO: 2758 - DNA, 50 bp, Artificial; identical to SEQ ID NO: 1889
  Synthetic

SEQ ID NO: 2759 - DNA, 50 bp, Artificial; identical to SEQ ID NO: 1890
  Synthetic

SEQ ID NO: 2760 - DNA, 50 bp, Artificial; identical to SEQ ID NO: 1891
  Synthetic

SEQ ID NO: 2761 - DNA, 50 bp, Artificial; identical to SEQ ID NO: 1884
  Synthetic

SEQ ID NO: 2762 - DNA, 50 bp, Artificial; identical to SEQ ID NO: 1893
  Synthetic

SEQ ID NO: 2763 - DNA, 50 bp, Artificial
  Synthetic
aacacctttcagagtatcggcatgagggaacgctttatttattgactggt

SEQ ID NO: 2764 - DNA, 50 bp, Artificial
  Synthetic
aaaactgctaagcctgcaattggtattagcaatatatagattagtttttt

SEQ ID NO: 2765 - DNA, 50 bp, Artificial
  Synthetic
cgctgattgatacgagccagaactacctgctcagaggaataggaaggttt

SEQ ID NO: 2766 - DNA, 50 bp, Artificial
  Synthetic
ccgtattcaggtcaaagtaaagttgcgctttatagctgataaatgttggc

SEQ ID NO: 2767 - DNA, 50 bp, Artificial
  Synthetic
acagctccgccaccgtcatgcctgttgtcagatatttttccgagatgggt

SEQ ID NO: 2768 - DNA, 50 bp, Artificial
  Synthetic
agctggcggaaaaccagatcgccaaaccgttggtcgccagtttccatttg

SEQ ID NO: 2769 - DNA, 50 bp, Artificial
  Synthetic
gtctacattgcccgaaatgtcctcattaccataatcgaaagcatgtagca

SEQ ID NO: 2770 - DNA, 50 bp, Artificial
  Synthetic
gattttttgatctcaactcgctgatttaacagattcggttcgctttcact

SEQ ID NO: 2771 - DNA, 50 bp, Artificial
  Synthetic
ccccaaccgttaacttcttcgaacgatgtatgaacataaacaccttcttc

SEQ ID NO: 2772 - DNA, 50 bp, Artificial
  Synthetic
aaccaaaccactacgttatcttgagtgtgccccgggccgggataaaaaac

SEQ ID NO: 2773 - DNA, 50 bp, Artificial
  Synthetic
gtgcctttgattttatagccgcgctccacaaaccaattgactaacttttc

SEQ ID NO: 2774 - DNA, 50 bp, Artificial
  Synthetic
cccccaatttcactatgactcgaaacaaccagttttgcattaccatactt

SEQ ID NO: 2775 - DNA, 50 bp, Artificial
  Synthetic
ctgccttttattttatagccacgttccacaaaccaagtgactaacttttc

SEQ ID NO: 2776 - DNA, 50 bp, Artificial
  Synthetic
tgtaccttaccgtcttttttaagaagttcatttgttaattcagatgcata

SEQ ID NO: 2777 - DNA, 50 bp, Artificial
  Synthetic
caggatagaaaacctctacgggaccgaagcgcaccacatctccactagag

SEQ ID NO: 2778 - DNA, 50 bp, Artificial
  Synthetic
tgtttttcgcaccccacgctgtatcaatcaaaagcaactcatcaccatca

SEQ ID NO: 2779 - DNA, 50 bp, Artificial
  Synthetic
tggctcttggctttccgtcccatttgaaaacctgatgctcattctttatg

SEQ ID NO: 2780 - DNA, 50 bp, Artificial
  Synthetic
ccgcttcttcagagaatttgcggttcatcagcatgcggtaagcacgatct

SEQ ID NO: 2781 - DNA, 50 bp, Artificial
  Synthetic
ccgctaacccggcgaaaataagttggtcaactttcagaccacaacgttcc

SEQ ID NO: 2782 - DNA, 50 bp, Artificial
  Synthetic
accgtcttcgttcagtacgcgataatcgtcaacaacgatggcacaatcga

SEQ ID NO: 2783 - DNA, 50 bp, Artificial
  Synthetic
cagccgtaagcggcggcaacgggtaaaagcagaaacaacaactccagcat

SEQ ID NO: 2784 - DNA, 50 bp, Artificial
  Synthetic
ctcacttccagccagcagtcggcggaaaagttcatcaccagatcctgcgc

SEQ ID NO: 2785 - DNA, 50 bp, Artificial
  Synthetic
ccggcaggctgatcctgctcatccagcaaaatgacgtgttccccggccat

SEQ ID NO: 2786 - DNA, 50 bp, Artificial
  Synthetic
tggaacgggatcgcaaagccaatgccttccggcgtttcgccgtcattgct

SEQ ID NO: 2787 - DNA, 50 bp, Artificial
  Synthetic
ttgccgttgacgctttcgataaacatcaccgcgttaccatcgctggcctg

SEQ ID NO: 2788 - DNA, 50 bp, Artificial
  Synthetic
cgccttcgccttatcgaaggtgtcgctggcgatcagatcgtgcatcgcgc

SEQ ID NO: 2789 - DNA, 50 bp, Artificial
  Synthetic
acttgcgcatactgcgggccgcgatccaacacgttgagaccagcgacagc

SEQ ID NO: 2790 - DNA, 50 bp, Artificial
  Synthetic
aacacgaccatcactgccaggttcgtcagcaggaaaagcgcgattcgcat

SEQ ID NO: 2791 - DNA, 50 bp, Artificial
  Synthetic
cagctgccaccgtcccagtagttaccgtaattgtcacgatcgcctatttg

SEQ ID NO: 2792 - DNA, 50 bp, Artificial
  Synthetic
ttgtggcaggttaagctgcggaagctggttcagaatggagtaacctaccc

SEQ ID NO: 2793 - DNA, 50 bp, Artificial
  Synthetic
cttccgattcctgacgctgggagaactgcgagttcaccagtttttcgccc

SEQ ID NO: 2794 - DNA, 50 bp, Artificial
  Synthetic
ccagttacgatccgcagtaatcgcctgattctgcttggtaatataaggca

SEQ ID NO: 2795 - DNA, 50 bp, Artificial
  Synthetic
atggtcattttcgctgactgacatgtagcctttggcctttcgcagttgca

SEQ ID NO: 2796 - DNA, 50 bp, Artificial
  Synthetic
ttaagacccagaccgccgacgttttcctcactgtggaataacaccccata

SEQ ID NO: 2797 - DNA, 50 bp, Artificial
  Synthetic
cggcttcggctttagcagccagttttgcttccagaccatctaaagtggtt

SEQ ID NO: 2798 - DNA, 50 bp, Artificial; identical to SEQ ID NO: 2780
  Synthetic

SEQ ID NO: 2799 - DNA, 50 bp, Artificial; identical to SEQ ID NO: 2781
  Synthetic

SEQ ID NO: 2800 - DNA, 50 bp, Artificial; identical to SEQ ID NO: 2782
  Synthetic

SEQ ID NO: 2801 - DNA, 50 bp, Artificial
  Synthetic
gcacttcggccgccacggcgacatggattttctcgccataccacagcact

SEQ ID NO: 2802 - DNA, 50 bp, Artificial
  Synthetic
gtttcgctggtctgctcaaacgcatcactgacgtggcggaacgcatccac

SEQ ID NO: 2803 - DNA, 50 bp, Artificial
  Synthetic
ctgtccagcgccggaaataacggattggccaacgcctgcgccagcttaac

SEQ ID NO: 2804 - DNA, 50 bp, Artificial; identical to SEQ ID NO: 2783
  Synthetic

SEQ ID NO: 2805 - DNA, 50 bp, Artificial
  Synthetic
gttcactaacgcaattaccaccatcccggcgaccagcgcacatttgatca

SEQ ID NO: 2806 - DNA, 50 bp, Artificial
  Synthetic
ccatcggttcaacggtaaagccgatcgcacgcaggcgttcaatcattaac

SEQ ID NO: 2807 - DNA, 50 bp, Artificial; identical to SEQ ID NO: 2784
  Synthetic

SEQ ID NO: 2808 - DNA, 50 bp, Artificial
  Synthetic
tgctcaagatggtcgtagaatcgctccagatcgtccaccagcgggtacgg

SEQ ID NO: 2809 - DNA, 50 bp, Artificial
  Synthetic
tcaaggcggatcgcctgatactgacgcgtatctttttcgcttttgcggat

SEQ ID NO: 2810 - DNA, 50 bp, Artificial; identical to SEQ ID NO: 2785
  Synthetic

SEQ ID NO: 2811 - DNA, 50 bp, Artificial
  Synthetic
tacaggcggctttcaccacgcgccaccggataaaccggcattaacggcgg

SEQ ID NO: 2812 - DNA, 50 bp, Artificial; identical to SEQ ID NO: 2786
  Synthetic

SEQ ID NO: 2813 - DNA, 50 bp, Artificial
  Synthetic
tatccgggcggataaccttgatcaccacctctttgccattctccttcaga

SEQ ID NO: 2814 - DNA, 50 bp, Artificial
  Synthetic
aattcctgggcaggctctgccggaatagacttgctttttaccagcacctg

SEQ ID NO: 2815 - DNA, 50 bp, Artificial
  Synthetic
gcggtcatagagggtacggatccagacgtcctgggcctgcatcacgatga

SEQ ID NO: 2816 - DNA, 50 bp, Artificial
  Synthetic
tttgtgcaacccccataccaataagcattgaggtcatcgcggcgctatcg

SEQ ID NO: 2817 - DNA, 50 bp, Artificial
  Synthetic
cgcatccaggagaagtacatattttcgtactgcttcggcacgaactgaat

SEQ ID NO: 2818 - DNA, 50 bp, Artificial; identical to SEQ ID NO: 2787
  Synthetic

SEQ ID NO: 2819 - DNA, 50 bp, Artificial
  Synthetic
cgacgccgatgcccaccagcatgccgaccacttcgccgcacagcatcggg

SEQ ID NO: 2820 - DNA, 50 bp, Artificial
  Synthetic
ggcaatacaggcaatacctgctggcaccgggttatttaaaattgggaaga

SEQ ID NO: 2821 - DNA, 50 bp, Artificial
  Synthetic
ctttcttcaccagcagacgggtaccgaccacgaagatggtatcggagaag

SEQ ID NO: 2822 - DNA, 50 bp, Artificial
  Synthetic
catcgatgtccggcgcgttaccattcagcaggttgatattttctgccgga

SEQ ID NO: 2823 - DNA, 50 bp, Artificial
  Synthetic
ctcttcaccgcgaccactttaccgttcagatctttgacatctttgatgtc

SEQ ID NO: 2824 - DNA, 50 bp, Artificial; identical to SEQ ID NO: 2795
  Synthetic

SEQ ID NO: 2825 - DNA, 50 bp, Artificial
  Synthetic
cagacagtgcgataccgttgtcgaacgcgtaggtggctgcggtgctgaag

SEQ ID NO: 2826 - DNA, 50 bp, Artificial
  Synthetic
gtttggattgaacaccgcctggcggatatcgcacagaaaaccaatccgct

SEQ ID NO: 2827 - DNA, 50 bp, Artificial
  Synthetic
tatccagagcgccatttataacatccgcttccataatctgtaaggcttcc

SEQ ID NO: 2828 - DNA, 50 bp, Artificial
  Synthetic
gcgccctcatagtcgatacgctgttcgccgaggaagtagacgccgcacag

SEQ ID NO: 2829 - DNA, 50 bp, Artificial
  Synthetic
gtaaggttaacgcgacggtgacgcccagtattcctgctaagcttttgttc

SEQ ID NO: 2830 - DNA, 50 bp, Artificial
  Synthetic
gcaaaaaggctttgatgcgtccaccaatccgttggtgcaggtacaccgct

SEQ ID NO: 2831 - DNA, 50 bp, Artificial
  Synthetic
cgaccgtcacggatggcgagtccggttgtcagcatattgacgatctgcct

SEQ ID NO: 2832 - DNA, 50 bp, Artificial; identical to SEQ ID NO: 2792
  Synthetic

SEQ ID NO: 2833 - DNA, 50 bp, Artificial
  Synthetic
gcccgttttttgcgatgcccggagatcgcatgatcgtgcgattcatcgcg

SEQ ID NO: 2834 - DNA, 50 bp, Artificial
  Synthetic
caggcatgttcatgtccatcaggacgacatctgcggaattagcccggcac

SEQ ID NO: 2835 - DNA, 50 bp, Artificial
  Synthetic
tgcagaaaatggagaaggtgacgtagcacagcagcttgtgcggcaggcga

SEQ ID NO: 2836 - DNA, 50 bp, Artificial
  Synthetic
ggttaatttggcacggctcagattcgacattgcgggctttttcgcttaac

SEQ ID NO: 2837 - DNA, 50 bp, Artificial
  Synthetic
ggaaaattcgccgcaccagttggtcagcacggtgacatatttaccgcgcg

SEQ ID NO: 2838 - DNA, 50 bp, Artificial
  Synthetic
ttgattaaatgagtttgccacttatccagtttggcgagacggtctgcgac

SEQ ID NO: 2839 - DNA, 50 bp, Artificial
  Synthetic
gccagctcccccaaaggcagaactgcaggaacgacagtattttgagctgc

SEQ ID NO: 2840 - DNA, 50 bp, Artificial
  Synthetic
accaggccgccaggaagacaatcgccatgatccataccggcgtcgggatc

SEQ ID NO: 2841 - DNA, 50 bp, Artificial
  Synthetic
ccacttcattttgcgtaatcgacgtgaagtaggtgtggtagaccgaatga

SEQ ID NO: 2842 - DNA, 50 bp, Artificial
  Synthetic
aactttttacccacttcagcgaggccgttgtagcctttgtcgccgttaat

SEQ ID NO: 2843 - DNA, 50 bp, Artificial
  Synthetic
ccgggccggagatatcccagtagtagaagtcgatcatgtgaacgtcatga

SEQ ID NO: 2844 - DNA, 50 bp, Artificial
  Synthetic
gcctgcccgtcatcgaccagcaggtcaaggacgaaatgttcgtcaaagcg

SEQ ID NO: 2845 - DNA, 50 bp, Artificial
  Synthetic
cggatggtcggtggcgggcggcggggcttccggcgttccctgcagggcgc

SEQ ID NO: 2846 - DNA, 50 bp, Artificial
  Synthetic
acatctgtttcatttcgttaaagccgctgaagccgaaggcgttggcaaaa

SEQ ID NO: 2847 - DNA, 50 bp, Artificial
  Synthetic
tgcacttccgtcaccacatgcatattaatgccgcgatcgacatttttgcg

SEQ ID NO: 2848 - DNA, 50 bp, Artificial
  Synthetic
gatagccccgaggtcatcaataatcgccagcgccatcaggaaaatcttca

SEQ ID NO: 2849 - DNA, 50 bp, Artificial
  Synthetic
cgggcagtcagagataatcatgtcgagcttatgctggctcagctgctcca

SEQ ID NO: 2850 - DNA, 50 bp, Artificial
  Synthetic
tgctgccagataaccagatcggcacgggccagcgccgcctgctcggcggc

SEQ ID NO: 2851 - DNA, 50 bp, Artificial
  Synthetic
ccgcgtacgtaattgaaggtggtttcgtccggcgcgaccaggcccgcttt

SEQ ID NO: 2852 - DNA, 50 bp, Artificial
  Synthetic
cggcaatcagcaccgcgaagacaatccccagcttgaccagcagccacagc

SEQ ID NO: 2853 - DNA, 50 bp, Artificial
  Synthetic
cgcggagacaatcccggaggtcacggtttcgcccagaccgaacgggttgc

SEQ ID NO: 2854 - DNA, 50 bp, Artificial
  Synthetic
tagtcggtcgcaatgatggcaatatggtgaacccgtttcaaacccagcat

SEQ ID NO: 2855 - DNA, 50 bp, Artificial
  Synthetic
cgtttggcgaggtgatcttcagcgcggtatggaccagaaacggcggaatg

SEQ ID NO: 2856 - DNA, 50 bp, Artificial
  Synthetic
cgggtgcgagccgctgaacatattggtcagcatattgcccagcaccacgc

SEQ ID NO: 2857 - DNA, 50 bp, Artificial
  Synthetic
cgcatctgcatctggtgcagaccatacagcagcggctcccaactgccgcg

SEQ ID NO: 2858 - DNA, 50 bp, Artificial
  Synthetic
cccgcgagggtcagacgacgctgcccggcggtgtggtccggcttcagcac

SEQ ID NO: 2859 - DNA, 50 bp, Artificial; identical to SEQ ID NO: 2797
  Synthetic

SEQ ID NO: 2860 - DNA, 50 bp, Artificial
  Synthetic
gaaataatcccggtgggtttattcgccgttttgtaggtcaggaacatcag

SEQ ID NO: 2861 - DNA, 50 bp, Artificial; identical to SEQ ID NO: 2789
  Synthetic

SEQ ID NO: 2862 - DNA, 50 bp, Artificial
  Synthetic
gatggacctcaaccagacggcggccatccggctcaaccgacgccttgatc

SEQ ID NO: 2863 - DNA, 50 bp, Artificial
  Synthetic
tgcaccagcagctcgttgaggtcgattcgcttctcaacatagtcctgagc

SEQ ID NO: 2864 - DNA, 50 bp, Artificial
  Synthetic
cgctgacatcgcaaaaggcctcatcgatactgtaaatttcgcagcgcggg

SEQ ID NO: 2865 - DNA, 50 bp, Artificial; identical to SEQ ID NO: 2788
  Synthetic

SEQ ID NO: 2866 - DNA, 50 bp, Artificial
  Synthetic
gccgccacccgggcgtcaactttatctttcagccgctgctggcgttcgcg

SEQ ID NO: 2867 - DNA, 50 bp, Artificial
  Synthetic
tgcagctgttccgcaccggtggacaccttactgttatagacacagccgga

SEQ ID NO: 2868 - DNA, 50 bp, Artificial
  Synthetic
cggatgtactggccgagggaatggccggtctctttcttaaacatacgttg

SEQ ID NO: 2869 - DNA, 50 bp, Artificial
  Synthetic
aatatccataggtgagaggtagtcattgagcaggcgatcttttttctggt

SEQ ID NO: 2870 - DNA, 50 bp, Artificial
  Synthetic
cgcctgatagccgaccagaccgtagttcacggcaagggagcgcgcccgtg

SEQ ID NO: 2871 - DNA, 50 bp, Artificial; identical to SEQ ID NO: 2796
  Synthetic

SEQ ID NO: 2872 - DNA, 50 bp, Artificial; identical to SEQ ID NO: 2790
  Synthetic

SEQ ID NO: 2873 - DNA, 50 bp, Artificial
  Synthetic
caatagccagcgtattacggccaaaggtggttttgtttagtaataatccg

SEQ ID NO: 2874 - DNA, 50 bp, Artificial; identical to SEQ ID NO: 2791
  Synthetic

SEQ ID NO: 2875 - DNA, 50 bp, Artificial
  Synthetic
cgcagaaattttggttgttacaggtgaccagccagtcgttgaagcgctgc

SEQ ID NO: 2876 - DNA, 50 bp, Artificial
  Synthetic
cgacgcaccatgtcggcttccgctctgccgccgaggcacagccccagcgc

SEQ ID NO: 2877 - DNA, 50 bp, Artificial
  Synthetic
tcgccccatgcgcgcttcgcggttcacataaacataattatcgccgcggc

SEQ ID NO: 2878 - DNA, 50 bp, Artificial
  Synthetic
tggataacgcgttcggtgagcgtcttgcgctgatgtggggtctgttgcat

SEQ ID NO: 2879 - DNA, 50 bp, Artificial; identical to SEQ ID NO: 2793
  Synthetic

SEQ ID NO: 2880 - DNA, 50 bp, Artificial
  Synthetic
cagccagttatcggcggtttcgtaataaatgttcagcaactggcccgcgg

SEQ ID NO: 2881 - DNA, 50 bp, Artificial
  Synthetic
gcagcagctggctcagtgggcaaaactgaatttcttcttccgccgccatg

SEQ ID NO: 2882 - DNA, 50 bp, Artificial
  Synthetic
ctgccatcgtcgatcaacagaatttcatattgccgccccagggtggcgca

SEQ ID NO: 2883 - DNA, 50 bp, Artificial
  Synthetic
cagatcatattgagagtggagacccaggtctgggacggcgtaatgacttc

SEQ ID NO: 2884 - DNA, 50 bp, Artificial
  Synthetic
tggcgataaacggcgcggaaactaccgccgggtcaatgccgatccgctta

SEQ ID NO: 2885 - DNA, 50 bp, Artificial
  Synthetic
cgatcgtcgctggcgcatcgtatttacaggccagcaggaactggctggtc

SEQ ID NO: 2886 - DNA, 50 bp, Artificial; identical to SEQ ID NO: 2794
  Synthetic

SEQ ID NO: 2887 - DNA, 50 bp, Artificial
  Synthetic
ctcaaggctgaacaacgccccggccagcgggacgttatagaccgccgcca

SEQ ID NO: 2888 - DNA, 50 bp, Artificial
  Synthetic
atcagaaacgccgcgtggatcgccgcgccgaaggcgtcgaggtagtcgag

SEQ ID NO: 2889 - DNA, 50 bp, Artificial
  Synthetic
cgaaccaggcgtttttctccgccatatgccccagcgtctcgaccatcatc

SEQ ID NO: 2890 - DNA, 50 bp, Artificial
  Synthetic
ttccagctggcgtgcagcagggcggcgaacagcaaaatgcagaatacggt

SEQ ID NO: 2891 - DNA, 50 bp, Artificial
  Synthetic
aaacgcatccagtacgtcatgcagcatctgcaccgtgtggcggcccagcg

SEQ ID NO: 2892 - DNA, 50 bp, Artificial
  Synthetic
ccagcgcgataacgcccgcccagcccgagaagtgctgcatctgcgccacc

SEQ ID NO: 2893 - DNA, 50 bp, Artificial
  Synthetic
tcaatagcacaatcagcgcagccagttttaccagcgcactgaaaatcatg

SEQ ID NO: 2894 - DNA, 50 bp, Artificial
  Synthetic
atctgcttaacgccaccagaggaaccaataccctggtagttcactttatt

SEQ ID NO: 2895 - DNA, 50 bp, Artificial
  Synthetic
tagcccttcttataataggcgcgatactcctccacgctcttgccgccggg

SEQ ID NO: 2896 - DNA, 50 bp, Artificial
  Synthetic
cacgagtaatgaccaccgcatgggagcgtgcatcctgcggcaataattgc

SEQ ID NO: 2897 - DNA, 50 bp, Artificial
  Synthetic
gcttcatcaaccagcttcatatgaccatcatgcaggttgcccatcgtcgg

SEQ ID NO: 2898 - DNA, 50 bp, Artificial
  Synthetic
atgatattcagcagggcgtgttccagcgtttcctgggtgcgctcgggcag

SEQ ID NO: 2899 - DNA, 50 bp, Artificial
  Synthetic
ccagtagcgttcgataaagtcgggccagttaagcgttaattgataatcca

SEQ ID NO: 2900 - DNA, 50 bp, Artificial
  Synthetic
cctgactgaataaggaagcgactcctgacgttccgcatacggcggcaaca

SEQ ID NO: 2901 - DNA, 50 bp, Artificial
  Synthetic
ctgcggccggcgcacgatcggcaccagcaccgccgcctgccgctgattga

SEQ ID NO: 2902 - DNA, 50 bp, Artificial
  Synthetic
agggagatatggtcggcgtcgagcccggcgatctccagtcccagtcgcgc

SEQ ID NO: 2903 - DNA, 50 bp, Artificial
  Synthetic
gtttgcgccagagcagcaaaatcgcccgcttcgatttcagtatacaatct

SEQ ID NO: 2904 - DNA, 50 bp, Artificial
  Synthetic
tggcaaaagccgtggatggtgaataccgccgcctcgtccatctgccgttc

SEQ ID NO: 2905 - DNA, 50 bp, Artificial
  Synthetic
ggcgctgtcaatcggccccattgccgggataatccggcgcagcggtccga

SEQ ID NO: 2906 - DNA, 50 bp, Artificial
  Synthetic
ccgtcattgctcttgtcaaaggagagggtgttaatccccatcagctcgcc

SEQ ID NO: 2907 - DNA, 50 bp, Artificial
  Synthetic
ggagttaacgacggcgataatcggtttgccgaaatcggcatcggtcattc

SEQ ID NO: 2908 - DNA, 50 bp, Artificial
  Synthetic
catgtaatcaagctcggttccaaccaccggcggcgcgttaaatgggatca

SEQ ID NO: 2909 - DNA, 50 bp, Artificial
  Synthetic
cgcgccagcactatcatgttgaagatagcgccgaaacagaaactgtgcag

SEQ ID NO: 2910 - DNA, 50 bp, Artificial
  Synthetic
cctggcgcggcgaccccatcgcgacggtgacgattttcgccccgctgtcg

SEQ ID NO: 2911 - DNA, 50 bp, Artificial
  Synthetic
tagaagttgagcaaacgcgacagcggcaaatagatctcggcaacctcttc

SEQ ID NO: 2912 - DNA, 50 bp, Artificial
  Synthetic
catggcgcagctggtgatagtaatccagcgaagaggtattggcctttttg

SEQ ID NO: 2913 - DNA, 50 bp, Artificial
  Synthetic
cggaacgggcgacaaagcgcagcagcgggcgggtcagatagcgcccaagg

SEQ ID NO: 2914 - DNA, 50 bp, Artificial
  Synthetic
ctgtttatgttcgaggttcatttccacataggtgtcggcctggttgccca

SEQ ID NO: 2915 - DNA, 50 bp, Artificial
  Synthetic
cagccgacggtggtgcgcggtttttcaaaatagacccgcatgacgatctc

SEQ ID NO: 2916 - DNA, 50 bp, Artificial
  Synthetic
attttctccgtcgcttcctgctctttcgcctggaaggtttccagccactc

SEQ ID NO: 2917 - DNA, 50 bp, Artificial
  Synthetic
tgcgataccgttgtcgaacgcgtaggtggctgcggtgctgaagccgtcgc

SEQ ID NO: 2918 - DNA, 50 bp, Artificial
  Synthetic
cgtttttgttatagatttctgcagcgttggctgcaccggctaccagcagg

SEQ ID NO: 2919 - DNA, 50 bp, Artificial
  Synthetic
taaagaacggcactttgccgacggtgcccagacggataccgcggaactcc

SEQ ID NO: 2920 - DNA, 50 bp, Artificial
  Synthetic
cgagaactcgatcggctcggtgataccggtcaggaacgaggtcagcgcgg

SEQ ID NO: 2921 - DNA, 50 bp, Artificial
  Synthetic
ccatcgccaggccgaggccggaaatcatcagttcaccgatagactgcagc

SEQ ID NO: 2922 - DNA, 50 bp, Artificial
  Synthetic
ctcagcagttcattcggatcaataccgtcagcaatcagcatttcacggta

SEQ ID NO: 2923 - DNA, 50 bp, Artificial
  Synthetic
gagcggtcagagaccgatcccatgatgaatttcgaaaatccataggcgat

SEQ ID NO: 2924 - DNA, 50 bp, Artificial
  Synthetic
aagccacgggtaggcgaaagtacaggtcgcgaggctcgccagcagcacca

SEQ ID NO: 2925 - DNA, 50 bp, Artificial
  Synthetic
aatcatccatccgctgcaggaacagcccctggcgttcgatctcctccagc

SEQ ID NO: 2926 - DNA, 50 bp, Artificial
  Synthetic
tttacgcgccagcgctttcaggtgttcttccgccgcgtttggggaacgga

SEQ ID NO: 2927 - DNA, 50 bp, Artificial
  Synthetic
gcacccgcttcgccatcagcaggccaataatgagggtggcgtactccgcg

SEQ ID NO: 2928 - DNA, 50 bp, Artificial
  Synthetic
cgtggatggtcttacccttgtacttaatctccagcgtttcgcggttatag

SEQ ID NO: 2929 - DNA, 50 bp, Artificial
  Synthetic
actcggtctgctctttcatttcgccggtctgcttgtcacgccaggattcg

SEQ ID NO: 2930 - DNA, 50 bp, Artificial
  Synthetic
gatgccaaaggcctcggcgacatgggcgctggcggggcgcagcaccgaca

SEQ ID NO: 2931 - DNA, 50 bp, Artificial
  Synthetic
actttgccgaagccgtgggcccagaaggtttcctgccaggccatctcaat

SEQ ID NO: 2932 - DNA, 50 bp, Artificial
  Synthetic
ccatcggccagtaaattgccattggcatctttaacgatcagaatgtcgct

SEQ ID NO: 2933 - DNA, 50 bp, Artificial
  Synthetic
ttcttctccacgtcgaggtggaagctgttggtgtagtaacctttgtcggt

SEQ ID NO: 2934 - DNA, 50 bp, Artificial
  Synthetic
gctgcaactgctttgttaaatagtgatcgtaatcgagcggcgactgctgg

SEQ ID NO: 2935 - DNA, 50 bp, Artificial
  Synthetic
aattattggtaactttcgactgatgttgacggagccggttcgcttcaaca

SEQ ID NO: 2936 - DNA, 50 bp, Artificial
  Synthetic
aatcccgtggctgcgctcccacagaatacgcccgaatttaccgaagcgct

SEQ ID NO: 2937 - DNA, 50 bp, Artificial
  Synthetic
aattccgggaacatatcggtccaggcttccacgtcgtacagggcgccaag

SEQ ID NO: 2938 - DNA, 50 bp, Artificial
  Synthetic
caccgctttgattcgcgccaccagctctttcggagagaaaggcttggtga

SEQ ID NO: 2939 - DNA, 50 bp, Artificial
  Synthetic
tcgacggtgtcgatatccgagtgcagatagcgcacgcgctcgccgtgctc

SEQ ID NO: 2940 - DNA, 50 bp, Artificial
  Synthetic
ctttagcagccagttttgcttccagaccatctaaagtggttgcgccttgc

SEQ ID NO: 2941 - DNA, 50 bp, Artificial; identical to SEQ ID NO: 2128
  Synthetic

SEQ ID NO: 2942 - DNA, 50 bp, Artificial
  Synthetic
cggcttcacccgcacttccgcctccgggaaaatgcgctgcatgcgtttgg

SEQ ID NO: 2943 - DNA, 50 bp, Artificial
  Synthetic
gtcgattcgcttctcaacatagtcctgagccgggctgggaaagccgcact

SEQ ID NO: 2944 - DNA, 50 bp, Artificial
  Synthetic
caccgctgacatcgcaaaaggcctcatcgatactgtaaatttcgcagcgc

SEQ ID NO: 2945 - DNA, 50 bp, Artificial
  Synthetic
ccgcttgttaaacagcggctgctgctctttaatcaaccgcgcctccagca

SEQ ID NO: 2946 - DNA, 50 bp, Artificial
  Synthetic
cagcaggctgtgggtgaagccgcggtggccaaaggcccgcgccacgggct

SEQ ID NO: 2947 - DNA, 50 bp, Artificial
  Synthetic
ccgatggagatcaccagctcggtctggtcaaaatcgtcgagggagacggt

SEQ ID NO: 2948 - DNA, 50 bp, Artificial
  Synthetic
cagcttctcaggcagggtgccggaaatcgaaacggtggcgatagagcgca

SEQ ID NO: 2949 - DNA, 50 bp, Artificial
  Synthetic
ggcgataataatcgaggagatgaccgccagcacaatatcaacgccgatca

SEQ ID NO: 2950 - DNA, 50 bp, Artificial
  Synthetic
gacattttttcctcaccttcgcggatcaccacatatttaatttcaaccgc

SEQ ID NO: 2951 - DNA, 50 bp, Artificial
  Synthetic
agtttccccggcgccaacttttaccgacattccctgcagttgattaacga

SEQ ID NO: 2952 - DNA, 50 bp, Artificial
  Synthetic
tcgataaacttctgcatgatacccaccagctgcagataaccgtcgttgtt

SEQ ID NO: 2953 - DNA, 50 bp, Artificial
  Synthetic
cgatttccgccatttccggatcgtcgctgccggagcgcagcaggttcagc

SEQ ID NO: 2954 - DNA, 50 bp, Artificial
  Synthetic
aaccgggcgctaagctcacgttccgcttcggtgttgactttcacaaaacg

SEQ ID NO: 2955 - DNA, 50 bp, Artificial; identical to SEQ ID NO: 2876
  Synthetic

SEQ ID NO: 2956 - DNA, 50 bp, Artificial
  Synthetic
atagttaccctggttgatgtcaggacggtaaaccactcgttccagagtgg

SEQ ID NO: 2957 - DNA, 50 bp, Artificial
  Synthetic
tcactttttcagtaaaggcggaaggtaacggttcgccgtatttacgctgt

SEQ ID NO: 2958 - DNA, 50 bp, Artificial
  Synthetic
gatctggttgataaagatcagcagcgtgttggactgcttcaggttacccg

SEQ ID NO: 2959 - DNA, 50 bp, Artificial
  Synthetic
ctgggctatcatgtttggccggtaattgagcgcttccgccgcctgcagca

SEQ ID NO: 2960 - DNA, 50 bp, Artificial
  Synthetic
ccagttttccgccaggcggcgcagcatattgaaatgctgttcaaggcttt

SEQ ID NO: 2961 - DNA, 50 bp, Artificial; identical to SEQ ID NO: 2890
  Synthetic

SEQ ID NO: 2962 - DNA, 50 bp, Artificial; identical to SEQ ID NO: 2894
  Synthetic

SEQ ID NO: 2963 - DNA, 50 bp, Artificial
  Synthetic
ggcgggtgactatcttattgcagccgcagaaataacacagcttatggcaa

SEQ ID NO: 2964 - DNA, 50 bp, Artificial
  Synthetic
aaaggcgcgcggcatatggttttcgagttctaaatagtcggcgagttccg

SEQ ID NO: 2965 - DNA, 50 bp, Artificial
  Synthetic
gcagatagtcaccagccccaggccctccgggaattccaccggcacatctt

SEQ ID NO: 2966 - DNA, 50 bp, Artificial
  Synthetic
ttatcagcaaaaggcagggcttccgcgttggcctgaacatactcaacgtt

SEQ ID NO: 2967 - DNA, 50 bp, Artificial
  Synthetic
ctgcaatacgccggtctgcttgatatccagcgccaccagacgtttaccct

SEQ ID NO: 2968 - DNA, 50 bp, Artificial
  Synthetic
gatccagacgtcctgggcctgcatcacgatgaagttgatgtccgagcccc

SEQ ID NO: 2969 - DNA, 50 bp, Artificial
  Synthetic
cgtaaccgatttcacttcaatatagcagttttgtcggtcatctgcctgta

SEQ ID NO: 2970 - DNA, 50 bp, Artificial
  Synthetic
atgacagaacctgtacaccacccgtttccagatcttgtttggcaatgtgc

SEQ ID NO: 2971 - DNA, 50 bp, Artificial
  Synthetic
ccgggcacttcggccgccacggcgacatggattttctcgccataccacag

SEQ ID NO: 2972 - DNA, 50 bp, Artificial
  Synthetic
taccgaggccagggtgttgtcggtgccgccggccagattctgggtgatct

SEQ ID NO: 2973 - DNA, 50 bp, Artificial
  Synthetic
aacgcagcttacgcttatggcgagcatattccagtacctggcagccctcg

SEQ ID NO: 2974 - DNA, 50 bp, Artificial
  Synthetic
tcgatatagccgctgccctgcacgtccatgatgaagttatccatcaacga

SEQ ID NO: 2975 - DNA, 50 bp, Artificial
  Synthetic
ccagcttgtcgttttgttccacctccgagaagcgcatgaccgtccatgac

SEQ ID NO: 2976 - DNA, 50 bp, Artificial
  Synthetic
gcggcaaaccgatagcgaatgtggctccctcttctaccaacaccacgtcg

SEQ ID NO: 2977 - DNA, 50 bp, Artificial
  Synthetic
acttccctggtgcccaacagatcttcttcgatacgaatgttgtttaacat

SEQ ID NO: 2978 - DNA, 50 bp, Artificial
  Synthetic
tcgacgccgacgtaggctttcgccagttcacagataaacggcagacgctc

SEQ ID NO: 2979 - DNA, 50 bp, Artificial
  Synthetic
agcagctcgcgcaggcgagccaccacggcggctttatcgttaaaatgttc

SEQ ID NO: 2980 - DNA, 50 bp, Artificial
  Synthetic
gatgaacagcgcggtcagcaggctgacgatggcgcgaaacgtcagatatg

SEQ ID NO: 2981 - DNA, 50 bp, Artificial
  Synthetic
ggtccatatggtcctcagtcacgttgaggatggttgccgccaccgcctgc

SEQ ID NO: 2982 - DNA, 50 bp, Artificial
  Synthetic
tagacgccgacataaaccacgaaccccatcacccccagccagcaggccag

SEQ ID NO: 2983 - DNA, 50 bp, Artificial
  Synthetic
acgatctgcaccacagcggtcaccagaatggtgccaaggataaccgcatg

SEQ ID NO: 2984 - DNA, 50 bp, Artificial
  Synthetic
gcggttagtgctggtcaggccacgacgtgaaacctggaacatcagcaccg

SEQ ID NO: 2985 - DNA, 50 bp, Artificial
  Synthetic
gcaggatacataccggcgataacctgagtcgcggcgatgtagacgatacc

SEQ ID NO: 2986 - DNA, 50 bp, Artificial
  Synthetic
ccgctgtggtccagcagggaacccagttcagaaaccgaaatggagatatc

SEQ ID NO: 2987 - DNA, 50 bp, Artificial
  Synthetic
accggacggaagaacagcgaggccagcaccagaatcatcgccacatagaa

SEQ ID NO: 2988 - DNA, 50 bp, Artificial
  Synthetic
ccgttctgagatttcacggcagccaggtaaccgaagtaggtccactgaat

SEQ ID NO: 2989 - DNA, 50 bp, Artificial
  Synthetic
aaccatcaggttagcgaggatacccaggctcacggcctccacaaaagtat

SEQ ID NO: 2990 - DNA, 50 bp, Artificial
  Synthetic
gggaaggcgcgagtttgaagttgtacaggtcaccgataccaccctgagaa

SEQ ID NO: 2991 - DNA, 50 bp, Artificial
  Synthetic
cggtccatagtcagcttacggaagatcacggagatcatctggaaggtgga

SEQ ID NO: 2992 - DNA, 50 bp, Artificial
  Synthetic
cgcggcggcgctcggcgacgatgatttgcaggcgttctttcgcaatatta

SEQ ID NO: 2993 - DNA, 50 bp, Artificial
  Synthetic
ataccgccgatgttgacgctggtgattttcacgccgccctcgacgatacg

SEQ ID NO: 2994 - DNA, 50 bp, Artificial
  Synthetic
acatgggttccagcagctgatcgtttttcgtctgtgaaaaagtggtgtat

SEQ ID NO: 2995 - DNA, 50 bp, Artificial
  Synthetic
ggagagcatcacaaccaccaccgtcaagccgacgatcagcagcggtagca

SEQ ID NO: 2996 - DNA, 50 bp, Artificial
  Synthetic
atccacatcaggttgaggtggaagaagccctggtatttttcgatttcacg

SEQ ID NO: 2997 - DNA, 50 bp, Artificial
  Synthetic
tggaaccaccaggtaccgaagaagcggccaggcgcactgttggcgatgga

SEQ ID NO: 2998 - DNA, 50 bp, Artificial
  Synthetic
caccgtcgataccctggtcgttaatgcccaggatggcgtaaacgataacc

SEQ ID NO: 2999 - DNA, 50 bp, Artificial
  Synthetic
catccagatactacggacctgggtgccgaaccccaccaataattctttta

SEQ ID NO: 3000 - DNA, 50 bp, Artificial
  Synthetic
cagagtaaagatcacgcgatcggagaagcgcgggatccagtcctctttaa

SEQ ID NO: 3001 - DNA, 50 bp, Artificial
  Synthetic
tcctgattgcggtgggtacgcttggtgaaacgatagcggcggaagctatg

SEQ ID NO: 3002 - DNA, 50 bp, Artificial
  Synthetic
gccagcatctttgctggtggaaatgttctggtaccactcgacgccgttgg

SEQ ID NO: 3003 - DNA, 50 bp, Artificial
  Synthetic
atggtcggtcccttgtcgcagttacccaggcagcaggtcggcagcagggt

SEQ ID NO: 3004 - DNA, 50 bp, Artificial
  Synthetic
aggttgtgtttcttggaaacatattcctgagagtcgcgcaggatggtcgg

SEQ ID NO: 3005 - DNA, 50 bp, Artificial
  Synthetic
tttcttttcggtgaaattaaggccggcaaagtggcgggcgttggtgtcat

SEQ ID NO: 3006 - DNA, 50 bp, Artificial
  Synthetic
gcgcaggaaaaagcgcatcgcgtcatggatcaccggattattgatcagat

SEQ ID NO: 3007 - DNA, 50 bp, Artificial
  Synthetic
ccgggtaaatacccagttcaccttcgctacccgttacctggattttttcg

SEQ ID NO: 3008 - DNA, 50 bp, Artificial
  Synthetic
aacagcagtacgtcacgaccttcgtcacggaatttctcagccatggtcag

SEQ ID NO: 3009 - DNA, 50 bp, Artificial
  Synthetic
cctgcaacatcacttttaccgggccgatcagttcggacagggatgggtta

SEQ ID NO: 3010 - DNA, 50 bp, Artificial
  Synthetic
tgttcatcaatccattcaatcaaagtttgaataatatcctgatgggacat

SEQ ID NO: 3011 - DNA, 50 bp, Artificial
  Synthetic
atcggtccaaagaagaccataaagcgcccgagatcggccgggttccagcg

SEQ ID NO: 3012 - DNA, 50 bp, Artificial
  Synthetic
catcaggaaaatcttcagcgccgtcgggacccggctacctaacagcgcca

SEQ ID NO: 3013 - DNA, 50 bp, Artificial; identical to SEQ ID NO: 2849
  Synthetic

SEQ ID NO: 3014 - DNA, 50 bp, Artificial
  Synthetic
gtcttccagcgagcccaggttagtcccggcagaagcagagatggtgccta

SEQ ID NO: 3015 - DNA, 50 bp, Artificial
  Synthetic
gccggtctctttcttaaacatacgttgcaggtgccacttagagtaaccgg

SEQ ID NO: 3016 - DNA, 50 bp, Artificial; identical to SEQ ID NO: 2869
  Synthetic

SEQ ID NO: 3017 - DNA, 50 bp, Artificial
  Synthetic
ttctcttcgtcaccggcccccggcaaggcatgaatgcgctgcgccgcctc

SEQ ID NO: 3018 - DNA, 50 bp, Artificial
  Synthetic
acgaccatcactgccaggttcgtcagcaggaaaagcgcgattcgcatcat

SEQ ID NO: 3019 - DNA, 50 bp, Artificial
  Synthetic
gtgccgatggcctcgcggccctgggcctgctcgctgttgataatatcagc

SEQ ID NO: 3020 - DNA, 50 bp, Artificial
  Synthetic
gcgataaacggcgcggaaactaccgccgggtcaatgccgatccgcttaag

SEQ ID NO: 3021 - DNA, 50 bp, Artificial
  Synthetic
gcctgcagcaccgcctgacgactggcttccttcacgccacgtgagccgct

SEQ ID NO: 3022 - DNA, 50 bp, Artificial
  Synthetic
aaagcggtttttgccgctctgccagttttccgccaggcggcgcagcatat

SEQ ID NO: 3023 - DNA, 50 bp, Artificial
  Synthetic
gctgctgcggcgtgcctttcaccaccagacgggtgccttccagttgaata

SEQ ID NO: 3024 - DNA, 50 bp, Artificial
  Synthetic
ttttcgtctaccagctcgacgttatacggagggtagccgccgttgctctg

SEQ ID NO: 3025 - DNA, 50 bp, Artificial
  Synthetic
aatttatgcagctgacgacctttcgcccctgcctgcgcaatcacactcat

SEQ ID NO: 3026 - DNA, 50 bp, Artificial
  Synthetic
ccgatttgcctgaggccaactccagcgcagtggaaactgcttcttccaga

SEQ ID NO: 3027 - DNA, 50 bp, Artificial
  Synthetic
gtttgcgcctgctgctgtaaaaccggataaagttctacaaagcgagccaa

SEQ ID NO: 3028 - DNA, 50 bp, Artificial
  Synthetic
aatgccccaccggtataaacggcgatatccattgtaccaccaccgatatc

SEQ ID NO: 3029 - DNA, 50 bp, Artificial
  Synthetic
aagcctttattcaattgctcggcttcactcatcatcagcccgtggctgac

SEQ ID NO: 3030 - DNA, 50 bp, Artificial
  Synthetic
gctctttgaggatctgaatcagagcttcttcgctcagttcattcaacgtt

SEQ ID NO: 3031 - DNA, 50 bp, Artificial
  Synthetic
cagtgaaacatcattgctacgccagcggcgaatcagtgacagaccgtcct

SEQ ID NO: 3032 - DNA, 50 bp, Artificial
  Synthetic
gtgtcgagatacagcttctgcggtacatagccgatgcgcagttttccgtt

SEQ ID NO: 3033 - DNA, 50 bp, Artificial
  Synthetic
cactgttcgtacatttgcatagtggtatccagcacccgtcgggcctgttc

SEQ ID NO: 3034 - DNA, 50 bp, Artificial
  Synthetic
catacggcgaatacaatccctggcaatgcttaatcccagaccgctgccct

SEQ ID NO: 3035 - DNA, 50 bp, Artificial
  Synthetic
atatcacgcacgccgtgaataaggttaacgaccgacttaccgacgctctc

SEQ ID NO: 3036 - DNA, 50 bp, Artificial
  Synthetic
cgcagactggccgttttcttaacatgcgggatctcatcgcccgtatgcat

SEQ ID NO: 3037 - DNA, 50 bp, Artificial
  Synthetic
tttcgcccggtaatgatagcgacttcaatatcagaggtgagcgcacaacg

SEQ ID NO: 3038 - DNA, 50 bp, Artificial
  Synthetic
tttagggtgcagctggcgattaactgcttcagtcaatgccgtcgctttgt

SEQ ID NO: 3039 - DNA, 50 bp, Artificial
  Synthetic
aatacgttcaatcggcaggcgctcgctcatgatagtgagcacttgctgac

SEQ ID NO: 3040 - DNA, 50 bp, Artificial
  Synthetic
cgcgcagcaaatcaagcagatcataagcgctgatagcgccatcctgcaga

SEQ ID NO: 3041 - DNA, 50 bp, Artificial
  Synthetic
tggtgtaagcgatggacggacgcagaccgaaatcgaactggtattgcgca

SEQ ID NO: 3042 - DNA, 50 bp, Artificial
  Synthetic
agagtagaacccaggattaccgcgcccagtaccagtttagtagctttcat

SEQ ID NO: 3043 - DNA, 50 bp, Artificial
  Synthetic
tacacggatggtcagctgcggatatttttccggatgcttaactgcatctt

SEQ ID NO: 3044 - DNA, 50 bp, Artificial
  Synthetic
tgcgtggtgtaacgaatttcaatggtatttccctggtgtttttgcagctg

SEQ ID NO: 3045 - DNA, 50 bp, Artificial
  Synthetic
cctgttgcataagatctcgcatctgctgacgctgatgttcggttaaactt

SEQ ID NO: 3046 - DNA, 50 bp, Artificial
  Synthetic
ccataggtcaccgatacaaacttcggtttcaggctgctaaggcgatcgat

SEQ ID NO: 3047 - DNA, 50 bp, Artificial
  Synthetic
atatcatcgtccgtcagctgtacgcctggcgtgccgaacagactgtccca

SEQ ID NO: 3048 - DNA, 50 bp, Artificial
  Synthetic
tctacgtgacgcttgttccagtaagccaccggcgctttttgcgtgcgtcc

SEQ ID NO: 3049 - DNA, 50 bp, Artificial
  Synthetic
gtaagtgcgagtcctgcggcggattggtgtagttaaacttgtcgtagttg

SEQ ID NO: 3050 - DNA, 50 bp, Artificial
  Synthetic
catcgacttcaacaacctcgcatcgggcacctgacgcgggtcgcaggtat

SEQ ID NO: 3051 - DNA, 50 bp, Artificial
  Synthetic
tcacggattgcttcgccgcaaaactccaccacatgcccggtgccgcctgc

SEQ ID NO: 3052 - DNA, 50 bp, Artificial
  Synthetic
acagaatgtcgccaaacaggttggagcacagcagaacgtcaaactgtgat

SEQ ID NO: 3053 - DNA, 50 bp, Artificial
  Synthetic
ctaactaactggctggtgcgccatatctcctggtgattaatggcggtgtg

SEQ ID NO: 3054 - DNA, 50 bp, Artificial
  Synthetic
attacgcggcatacgcggcgtattaacggttgtgctaccttctacgttaa

SEQ ID NO: 3055 - DNA, 50 bp, Artificial
  Synthetic
atgccgaaggcaaactgggctttcagtcctggggagaaccgtcgtaaagg

SEQ ID NO: 3056 - DNA, 50 bp, Artificial
  Synthetic
aaacctttaatgccttcggcatactggaacgccaggctaccgagtggcgt

SEQ ID NO: 3057 - DNA, 50 bp, Artificial
  Synthetic
tcaatacgacctgtttcccctttaccgcggataaccactcattatcacgg

SEQ ID NO: 3058 - DNA, 50 bp, Artificial
  Synthetic
aaatggtgccgacacctaaaccaatttccacccgtgggcgacctgtttcc

SEQ ID NO: 3059 - DNA, 50 bp, Artificial
  Synthetic
cgcttcgaccggctgaaagccattttgttcgagcacgaagcagaccattt

SEQ ID NO: 3060 - DNA, 50 bp, Artificial
  Synthetic
cgccaccatcagcaactgtttgtgggtataaggcatgacgcgaatttcca

SEQ ID NO: 3061 - DNA, 50 bp, Artificial
  Synthetic
atattatgtagcggttgtcccaccagactcacttcgccactgctgccgtc

SEQ ID NO: 3062 - DNA, 50 bp, Artificial
  Synthetic
ttgtcatacaccgttttacaacgctgttgcgtagtcgtgtaagtatcgct

SEQ ID NO: 3063 - DNA, 50 bp, Artificial
  Synthetic
cattccccaccacggcgtgggaacgaaattaaccgccacactcagcagta

SEQ ID NO: 3064 - DNA, 50 bp, Artificial
  Synthetic
cgcaacaatttctgcaacctgtgcgctgtcagtttttgccatttcgttgg

SEQ ID NO: 3065 - DNA, 50 bp, Artificial
  Synthetic
cacctttcagtacgccattaacaccattgccagtaagtaaaccaacgcct

SEQ ID NO: 3066 - DNA, 50 bp, Artificial
  Synthetic
tccacattctttacccacacaaattcatgtcctttgtgccctgccatgag

SEQ ID NO: 3067 - DNA, 50 bp, Artificial
  Synthetic
ccagcggagacagatactcgttaagcagacgatctttcttctgattaacc

SEQ ID NO: 3068 - DNA, 50 bp, Artificial
  Synthetic
tgttcttccatttttgcgatctgcgcttcagcttttgctttatcgaaggt

SEQ ID NO: 3069 - DNA, 50 bp, Artificial
  Synthetic
cacattcgcaacatactcgattcggttcggctcaatgataacgtcggcat

SEQ ID NO: 3070 - DNA, 50 bp, Artificial
  Synthetic
aagcgttgcaccatagagattaacgatgcattggttttcgctcgctcgcg

SEQ ID NO: 3071 - DNA, 50 bp, Artificial
  Synthetic
ctgggcggtttccagattcggtttttcgacaaactgcgccacttcaaagg

SEQ ID NO: 3072 - DNA, 50 bp, Artificial
  Synthetic
cagcgtttcgtctttctgcacgcgccctcccggcacaaaccagtaaccct

SEQ ID NO: 3073 - DNA, 50 bp, Artificial
  Synthetic
acgtagtctttggcatggccccagtcacgcagggaatccatattgccgag

SEQ ID NO: 3074 - DNA, 50 bp, Artificial
  Synthetic
ttttgcgatatcaccgaatgtgcgccaatggttatttcaccgagggtata

SEQ ID NO: 3075 - DNA, 50 bp, Artificial
  Synthetic
tgatgctgagccaaattgagattaatgccagagcgaaaaatgccggttcg

SEQ ID NO: 3076 - DNA, 50 bp, Artificial
  Synthetic
ttcggtatcgaacaaacactctttgaaacgccacgcccaggtaaagacct

SEQ ID NO: 3077 - DNA, 50 bp, Artificial
  Synthetic
agactggtttccacttctttcaatgtgttgaccgcataacgcgccaccat

SEQ ID NO: 3078 - DNA, 50 bp, Artificial
  Synthetic
gccatctcgcataagcgttcgatatggcgcttttccatggtcaaaatcag

SEQ ID NO: 3079 - DNA, 50 bp, Artificial
  Synthetic
taatagttggcagcaactgattgatcagacggttccagcgggaaaccggg

SEQ ID NO: 3080 - DNA, 50 bp, Artificial
  Synthetic
cggcgataaccaccacgattacgattacccaacgggatttataactgcct

SEQ ID NO: 3081 - DNA, 50 bp, Artificial
  Synthetic
atttcacctgcgtttgctgcaagcggggtaaatgccatcagggcggccgc

SEQ ID NO: 3082 - DNA, 50 bp, Artificial
  Synthetic
ccgcttgtttttcaatggtaatcacttcgtgtccggctttacggaactcg

SEQ ID NO: 3083 - DNA, 50 bp, Artificial
  Synthetic
gcgcaccgcatggcaaacacgcaatgcttcgtaagttatttgctgatgaa

SEQ ID NO: 3084 - DNA, 50 bp, Artificial
  Synthetic
gtcgccaatacgctccagctcggcaatggttttactgatcaccataacca

SEQ ID NO: 3085 - DNA, 50 bp, Artificial
  Synthetic
aattatgtcgccctttttacccggtgggttaaaagcaggcttggttgcag

SEQ ID NO: 3086 - DNA, 50 bp, Artificial
  Synthetic
cgctcatcgataaggtcgcggcgacaacagttgcgacggtggtacgcata

SEQ ID NO: 3087 - DNA, 50 bp, Artificial
  Synthetic
catctggcgcgcttgctcaacttcggcatgtgggaaagtcacttcgtttt

SEQ ID NO: 3088 - DNA, 50 bp, Artificial
  Synthetic
gcaatttgtgcttccgcagctatcgaattggctgctatttcaccaaccac

SEQ ID NO: 3089 - DNA, 50 bp, Artificial
  Synthetic
acgaagcaaccggcaccgataatcacgttatcgcccagttcaacgccgga

SEQ ID NO: 3090 - DNA, 50 bp, Artificial
  Synthetic
aagtcatagagctgaatcagtcgctgaccatagcgggtcagtactgcgcc

SEQ ID NO: 3091 - DNA, 50 bp, Artificial
  Synthetic
aacatcaattgctttctgccactcactggtagcctggtagatttgtagca

SEQ ID NO: 3092 - DNA, 50 bp, Artificial
  Synthetic
agcacggaagatacagaatcaggctgtttatccagatctgcgttagccat

SEQ ID NO: 3093 - DNA, 50 bp, Artificial
  Synthetic
cccagatcgtaaacctgcgtaccaggttgaacgaagcgctcggctaacat

SEQ ID NO: 3094 - DNA, 50 bp, Artificial
  Synthetic
gctgccgtgtgaccacggaaggtacgaaatttattgcccaggcgtacatc

SEQ ID NO: 3095 - DNA, 50 bp, Artificial
  Synthetic
gacatacattttagcgatgcgatgcggcgtttccatcaaactgtcatcag

SEQ ID NO: 3096 - DNA, 50 bp, Artificial
  Synthetic
ttaatcttttcgaaccccgcctgcggcaggaacacttcaccacgcacttc

SEQ ID NO: 3097 - DNA, 50 bp, Artificial
  Synthetic
gggttaatacgcagacaatcgacgccgtattccgctactttcagcgcaat

SEQ ID NO: 3098 - DNA, 50 bp, Artificial
  Synthetic
atgtcgcgtaccgtggaaaccttcaggcaaagtcgctcggcaacggcctg

SEQ ID NO: 3099 - DNA, 50 bp, Artificial
  Synthetic
tttcaatgaccgtttttaccgcccactctgccaccgagcctttatcaacc

SEQ ID NO: 3100 - DNA, 50 bp, Artificial
  Synthetic
accggcttcgtgtcccaacgcaccaaacgtttcggtaatttgtagcgcaa

SEQ ID NO: 3101 - DNA, 50 bp, Artificial
  Synthetic
cagcgtccgtcagacatcggcaacatcgccagcgggccatgttgcgtaaa

SEQ ID NO: 3102 - DNA, 50 bp, Artificial
  Synthetic
atcgtaaatagcccagctattgccgccctgcaatcccgcattacgcgtgg

SEQ ID NO: 3103 - DNA, 50 bp, Artificial
  Synthetic
gcctgtatgttcaccgttagcaatgcgaatggctgaacattttagatcct

SEQ ID NO: 3104 - DNA, 50 bp, Artificial
  Synthetic
gttcttactctttttttctgttgcgacaggttgtgacgtggtgtccacgg

SEQ ID NO: 3105 - DNA, 50 bp, Artificial
  Synthetic
atcaacaacgcccagagcgcggaaaagggcaattgcgcggtgggctgctc

SEQ ID NO: 3106 - DNA, 50 bp, Artificial
  Synthetic
tggttgtccatggtctgaatacgtgcgtcgagcattttcaccgtttcaat

SEQ ID NO: 3107 - DNA, 50 bp, Artificial
  Synthetic
taagggctccagctcgcgcaccacatcaccaatacgtatcgcactcgccg

SEQ ID NO: 3108 - DNA, 50 bp, Artificial
  Synthetic
ttaatcagccctttccagcccaccgtggtacgcggcttttcaaaatagac

SEQ ID NO: 3109 - DNA, 50 bp, Artificial
  Synthetic
ataaactgcgacagtgcgcggtgcatgcgagcaatctgccctttcattac

SEQ ID NO: 3110 - DNA, 50 bp, Artificial
  Synthetic
tcgcacttcttatcatcctgaaggatttcatgggtacggttgatttcaga

SEQ ID NO: 3111 - DNA, 50 bp, Artificial
  Synthetic
ttgttggtatcaatggaacgataaccggaaatgagttgcaccggtttgcg

SEQ ID NO: 3112 - DNA, 50 bp, Artificial
  Synthetic
gctactaacagagcagggacgatcactgccagaatattgcgcttcatcat

SEQ ID NO: 3113 - DNA, 50 bp, Artificial
  Synthetic
tgattccgcagaaatccctgcccctgtcagtacgagtactcttggttttt

SEQ ID NO: 3114 - DNA, 50 bp, Artificial
  Synthetic
aacataatatgctgcaggcgcgcttcgacatccactttggtcaggtaggt

SEQ ID NO: 3115 - DNA, 50 bp, Artificial
  Synthetic
atagataccgcttttgccagcagttgctgactttccggtgtaaccgcaac

SEQ ID NO: 3116 - DNA, 50 bp, Artificial
  Synthetic
ggtgtaaagcatggcgaaaccatcaacgcgcatcagcggcgtaacgtcca

SEQ ID NO: 3117 - DNA, 50 bp, Artificial
  Synthetic
cccacagtgcgatcaggaagtacatcggcaccagcatcatttcccagaag

SEQ ID NO: 3118 - DNA, 50 bp, Artificial
  Synthetic
cattcgcgtttcgcgtttggcgaacgcgtgcaggccgatcatccagatac

SEQ ID NO: 3119 - DNA, 50 bp, Artificial
  Synthetic
cgcatcatttcggtttcgctgtggtagcgattaaacaccggatgggtgag

SEQ ID NO: 3120 - DNA, 50 bp, Artificial
  Synthetic
aatcggcagaccgaggaaacggttgagcacgattttatctaccgcagtgg

SEQ ID NO: 3121 - DNA, 50 bp, Artificial
  Synthetic
acgaatcagcatgcggtcatataacgcttccagactgctgtctgcttccg

SEQ ID NO: 3122 - DNA, 50 bp, Artificial
  Synthetic
atccagttcgccgagaataccgataacaccaccagcacggtgaacatctt

SEQ ID NO: 3123 - DNA, 50 bp, Artificial
  Synthetic
ctggtatgagagataagcaacttctttgttttgctcgagcttcgctgcca

SEQ ID NO: 3124 - DNA, 50 bp, Artificial
  Synthetic
ttttccttcgcctaatagctcctgagcgacagtttccagcgagaatgaag

SEQ ID NO: 3125 - DNA, 50 bp, Artificial
  Synthetic
aaaaacaggccgtaggcttcgctccagcctttggtgaccgtgaccgtttt

SEQ ID NO: 3126 - DNA, 50 bp, Artificial
  Synthetic
atttacgcgcgggataattggcggtgctgatcaccccccgacgttcgcgg

SEQ ID NO: 3127 - DNA, 50 bp, Artificial
  Synthetic
ccgaggagtcgccaccaaattccgggaacatatcggtccaggcttccacg

SEQ ID NO: 3128 - DNA, 50 bp, Artificial
  Synthetic
cagaccatttttgtccctgaaatagtggctgatgatccccgtagaaacgc

SEQ ID NO: 3129 - DNA, 50 bp, Artificial
  Synthetic
gcttcgaccggctgaaagccattttgttcgagcacgaagcagaccatttc

SEQ ID NO: 3130 - DNA, 50 bp, Artificial
  Synthetic
tgcgccagaccgttacaccagaaaataccgccctcttccgtggtcagcac

SEQ ID NO: 3131 - DNA, 50 bp, Artificial
  Synthetic
gaaatccagcacgtcgatatcttcatagcggtagcgtgggtagacatcga

SEQ ID NO: 3132 - DNA, 50 bp, Artificial
  Synthetic
taccgtagccagaccaatttcttcacccatatcgatcagacgtttgtata

SEQ ID NO: 3133 - DNA, 50 bp, Artificial
  Synthetic
atcagcccggcaataaacaccgccagcaggacaaacagcatcatgccgta

SEQ ID NO: 3134 - DNA, 50 bp, Artificial
  Synthetic
cgcgagtagttttcaatccccgaacagtagcccagctcgttcatcatctc

SEQ ID NO: 3135 - DNA, 50 bp, Artificial
  Synthetic
atggcaacagtagaagttgcgtcatcatgggctgatcttcgcgatagaca

SEQ ID NO: 3136 - DNA, 50 bp, Artificial
  Synthetic
agccccagctggcaatggagaagttttcgctatggtgacttcaattcgca

SEQ ID NO: 3137 - DNA, 50 bp, Artificial
  Synthetic
aatcaccacttgctttgacgaagtaagtcgcgctgggatgctggatcaac

SEQ ID NO: 3138 - DNA, 50 bp, Artificial
  Synthetic
atttgataaatccaccaccccacccgtctgccgctgccatttttttgccg

SEQ ID NO: 3139 - DNA, 50 bp, Artificial
  Synthetic
gcacgacgcagggcatcaaccataacgactaattccatcaggttgtcgtt

SEQ ID NO: 3140 - DNA, 50 bp, Artificial
  Synthetic
agcacgggcgtcagctcggcatttttggcaaataccgcacaagcaataga

SEQ ID NO: 3141 - DNA, 50 bp, Artificial
  Synthetic
cttcacgttgctcgtcttccatttgcactggagaatttgtcagccaggtg

SEQ ID NO: 3142 - DNA, 50 bp, Artificial
  Synthetic
taaagtacgcgacggtgtaccggcttcaggccatctcggacatctggcag

SEQ ID NO: 3143 - DNA, 50 bp, Artificial
  Synthetic
gatggattttgtcgagattgatgcgctctgtgctaccgtcgcgctttgtc

SEQ ID NO: 3144 - DNA, 50 bp, Artificial
  Synthetic
aagtacggtaccggctccagcgtttcttcattacggtacataccgacaac

SEQ ID NO: 3145 - DNA, 50 bp, Artificial
  Synthetic
tagatcatccttcagcaatttgtcgagcgtttcaccggtcgcattaatca

SEQ ID NO: 3146 - DNA, 50 bp, Artificial
  Synthetic
gacgtttgtactcttcgtcgatttgttcaaactctccgggctgcggatta

SEQ ID NO: 3147 - DNA, 50 bp, Artificial
  Synthetic
gcataaacagatcgcggtacataccgtatggccatgcaattaagatgttc

SEQ ID NO: 3148 - DNA, 50 bp, Artificial
  Synthetic
cagtgcgcaccagtcgatgtcacattcacgcatcgctttttctgtcgctt

SEQ ID NO: 3149 - DNA, 50 bp, Artificial
  Synthetic
cctttaccaaattgtttctcaatctggcccagtgctgccgccaacgcttt

SEQ ID NO: 3150 - DNA, 50 bp, Artificial
  Synthetic
cccggcgataccactaatagacacggcataatcagcacgagccgctttca

SEQ ID NO: 3151 - DNA, 50 bp, Artificial
  Synthetic
ctttgttgttctcactggcggcgagcattttttcataacagcgggttatc

SEQ ID NO: 3152 - DNA, 50 bp, Artificial
  Synthetic
acgacgacgaacttccgccagaacacctgctttttcgcaggaacgcttga

SEQ ID NO: 3153 - DNA, 50 bp, Artificial
  Synthetic
attgaaaatacggcaccgtgtttgcaattgagagtaatctttgatgctct

SEQ ID NO: 3154 - DNA, 50 bp, Artificial
  Synthetic
cgtgacgttcagttcttcaatggtgatttcctgaaaagccagtcggctct

SEQ ID NO: 3155 - DNA, 50 bp, Artificial
  Synthetic
gcccgccgtcttttcggttcagtatgtttcagtacggacatgaaaatagg

SEQ ID NO: 3156 - DNA, 50 bp, Artificial
  Synthetic
ggcatagaagaacaggaagttgtagctgatttgcttccatactgaggcaa

SEQ ID NO: 3157 - DNA, 50 bp, Artificial
  Synthetic
ggcgttaaaacgttgggccagagaatccacctctttacccagttcccctt

SEQ ID NO: 3158 - DNA, 50 bp, Artificial
  Synthetic
agggtcgccgttttgtactaccaggtaacaggcatagcgggagagatgaa

SEQ ID NO: 3159 - DNA, 50 bp, Artificial
  Synthetic
aaagatctgccacttggtcatatcggtagattctgtctctttgtcctctt

SEQ ID NO: 3160 - DNA, 50 bp, Artificial
  Synthetic
tgaggaactctccttgcgccagacgtaaggcgcacatcaacagcttaagc

SEQ ID NO: 3161 - DNA, 50 bp, Artificial
  Synthetic
atcggtagcgtaggacgaccacctaacggaccgctcacctgttgtagcgg

SEQ ID NO: 3162 - DNA, 50 bp, Artificial
  Synthetic
gtgtttgacgtttacgttagaacgataggtcggttctgccggggccggga

SEQ ID NO: 3163 - DNA, 50 bp, Artificial; identical to SEQ ID NO: 3085
  Synthetic

SEQ ID NO: 3164 - DNA, 50 bp, Artificial
  Synthetic
gctcatcgataaggtcgcggcgacaacagttgcgacggtggtacgcataa

SEQ ID NO: 3165 - DNA, 50 bp, Artificial
  Synthetic
tcatcttcactgatggtttcgtggcgggttaaggtacttcccacgcacac

SEQ ID NO: 3166 - DNA, 50 bp, Artificial
  Synthetic
tcccagcaaacggatatggttacgcaccgacgcgatatgttcctgtagcg

SEQ ID NO: 3167 - DNA, 50 bp, Artificial
  Synthetic
gtttattaactgaacctggggcatcaaataccagttcggcaatgccatct

SEQ ID NO: 3168 - DNA, 50 bp, Artificial
  Synthetic
gctgatgtgatcacggatgagatcaaacacctcttgttgcctggccgtta

SEQ ID NO: 3169 - DNA, 50 bp, Artificial
  Synthetic
gccgaccactaacaaaattactggcgcacgggcatattgcacgccgagta

SEQ ID NO: 3170 - DNA, 50 bp, Artificial
  Synthetic
gatttgccagaacccgaaagcccggtcacgacaatgagcttgtcgcgggg

SEQ ID NO: 3171 - DNA, 50 bp, Artificial
  Synthetic
ctaagaagttgccagcgaagaagaaccacgccagtggtgagggtagccat

SEQ ID NO: 3172 - DNA, 50 bp, Artificial
  Synthetic
aaaatcggacgctcggtggtgcgcaactcaacggcggccagtaacaggcg

SEQ ID NO: 3173 - DNA, 50 bp, Artificial
  Synthetic
ttccgcttcgccagcagatcgttcaggttgttgatcggactatctttgtt

SEQ ID NO: 3174 - DNA, 50 bp, Artificial
  Synthetic
tcgcagtagcgcagggcgtaatccacctgatgcagcgtgacgaccacggt

SEQ ID NO: 3175 - DNA, 50 bp, Artificial
  Synthetic
gcagatttagtttcaacttctttacgcttgacgatcacgcgatcatgcaa

SEQ ID NO: 3176 - DNA, 50 bp, Artificial
  Synthetic
taccgtcttcaacggtgataacgccttctttaccgactttgtccatcgct

SEQ ID NO: 3177 - DNA, 50 bp, Artificial
  Synthetic
agtttgtgatagtcacggcccagcgcataacggctaacatagccgagttt

SEQ ID NO: 3178 - DNA, 50 bp, Artificial
  Synthetic
ctgatcccttgctgaaaggcattcggctcgctttcctgctcactaacacg

SEQ ID NO: 3179 - DNA, 50 bp, Artificial
  Synthetic
gaaacaattttgtccgccacacaggccatcatgtaaccgccgctggcagc

SEQ ID NO: 3180 - DNA, 50 bp, Artificial
  Synthetic
ttcttcatggaagtacagacctggcttgtcatcatgggcgatgttttcgt

SEQ ID NO: 3181 - DNA, 50 bp, Artificial
  Synthetic
caaatgggctttctgttttttctggttcgatctggcttaacgccatttgt

SEQ ID NO: 3182 - DNA, 50 bp, Artificial
  Synthetic
gatttccggttttttgctctctttgttcggcacgcgaccaaaggtgtccg

SEQ ID NO: 3183 - DNA, 50 bp, Artificial; identical to SEQ ID NO: 3100
  Synthetic

SEQ ID NO: 3184 - DNA, 50 bp, Artificial
  Synthetic
cctttggtcaggcgggcagttcacacgcagtgaacggccaaaaatttgga

SEQ ID NO: 3185 - DNA, 50 bp, Artificial
  Synthetic
tttggcaacggctgcaccgatttttgcattaaatcctgcggatgcgcatg

SEQ ID NO: 3186 - DNA, 50 bp, Artificial
  Synthetic
cgagatacagaggagccagggtttcgttggtgaccaacatgacctgctcg

SEQ ID NO: 3187 - DNA, 50 bp, Artificial
  Synthetic
aattgacgcggacatcgctttcgccaatgccttcgccagcggcaccaacc

SEQ ID NO: 3188 - DNA, 50 bp, Artificial
  Synthetic
taaccaggccggacgcaccgcttcgatgggatcgatagattcacgccagt

SEQ ID NO: 3189 - DNA, 50 bp, Artificial
  Synthetic
tacgcagatattcgctggccacttctgccagtttgccgaacagcacaacg

SEQ ID NO: 3190 - DNA, 50 bp, Artificial
  Synthetic
taaacggattgcgcgccggttcgctgacgcgcggtgcgacaaccgcaggc

SEQ ID NO: 3191 - DNA, 50 bp, Artificial
  Synthetic
tcgttttcacgcgcggcaatcgcatcgtcaaacgccgcttttacttcttc

SEQ ID NO: 3192 - DNA, 50 bp, Artificial; identical to SEQ ID NO: 3106
  Synthetic

SEQ ID NO: 3193 - DNA, 50 bp, Artificial
  Synthetic
atcaatatcccagaaggctttatgcaggccgagcgcaatgcccagctgcg

SEQ ID NO: 3194 - DNA, 50 bp, Artificial
  Synthetic
tttttccagggtttccagatcgtctgcggaaagatggtgttcgatggtgt

SEQ ID NO: 3195 - DNA, 50 bp, Artificial
  Synthetic
ggtgcccattaccgcgctggtttcgccaagcagttggctccactgcgcca

SEQ ID NO: 3196 - DNA, 50 bp, Artificial
  Synthetic
gttgttgagattgcctgccgtataaagcgtgttgccgcactggcttaaaa

SEQ ID NO: 3197 - DNA, 50 bp, Artificial
  Synthetic
tgacagaaagcgtttctaccacgaacacgccccccataatcaccagcagg

SEQ ID NO: 3198 - DNA, 50 bp, Artificial
  Synthetic
cgagacagcaggagagatcaggcctttaaccagcacccgattcttcgtcc

SEQ ID NO: 3199 - DNA, 50 bp, Artificial
  Synthetic
aggcagcccctgtcatcaccatccagaacggaatcaccgtcagaatgatc

SEQ ID NO: 3200 - DNA, 50 bp, Artificial
  Synthetic
accagaacgaacggcagttcgaaaatgtccttacctgtcgggccgcctgc

SEQ ID NO: 3201 - DNA, 50 bp, Artificial
  Synthetic
ctggtactgtgcggctgtgacatgattcatatccggcgcatagcgggaga

SEQ ID NO: 3202 - DNA, 50 bp, Artificial
  Synthetic
gcgggtttcttcaatcttggagcggtagtcaaaaccgaccggacggaaga

SEQ ID NO: 3203 - DNA, 50 bp, Artificial
  Synthetic
gatttccagttcactggtcttcgcggcaaaacgagatgggtcccaaaaca

SEQ ID NO: 3204 - DNA, 50 bp, Artificial
  Synthetic
ttcgtcgagatacgaggtactccagaggattaacatcccttcgcccgcca

SEQ ID NO: 3205 - DNA, 50 bp, Artificial
  Synthetic
ttcacgtcttcgttacagataggcatgatcaacgccgtgcgatgctccgg

SEQ ID NO: 3206 - DNA, 50 bp, Artificial
  Synthetic
ataatggcgcaaccacaaaactggggataacaaccccggtcattgccagc

SEQ ID NO: 3207 - DNA, 50 bp, Artificial
  Synthetic
tctttggatgaaagaccatagcgcccaccaatgacacggggcagagtttc

SEQ ID NO: 3208 - DNA, 50 bp, Artificial
  Synthetic
ctgtcagatggttgccaataaagccattcaccccgaggatgagtacccgg

SEQ ID NO: 3209 - DNA, 50 bp, Artificial; identical to SEQ ID NO: 3116
  Synthetic

SEQ ID NO: 3210 - DNA, 50 bp, Artificial; identical to SEQ ID NO: 3117
  Synthetic

SEQ ID NO: 3211 - DNA, 50 bp, Artificial
  Synthetic
atgtagccaatctggctcatggtagagtaagcgagaacacgtttgatgtc

SEQ ID NO: 3212 - DNA, 50 bp, Artificial
  Synthetic
ccgatactcgcttctgccgccgcgaggctgatggcgagaatgtacatcac

SEQ ID NO: 3213 - DNA, 50 bp, Artificial
  Synthetic
gtcgataccctgatcgttaacaccgaggatggcgtaaacaatcaccacca

SEQ ID NO: 3214 - DNA, 50 bp, Artificial; identical to SEQ ID NO: 3118
  Synthetic

SEQ ID NO: 3215 - DNA, 50 bp, Artificial
  Synthetic
ccaccgaagaacagcgtcaccatcaatgcagagatggtcacaatcccgat

SEQ ID NO: 3216 - DNA, 50 bp, Artificial
  Synthetic
atacaggacatcaccaggcgaccacgcgtgtcttccgcgttttggtattg

SEQ ID NO: 3217 - DNA, 50 bp, Artificial
  Synthetic
taccactccacgccgttagcgaggatcgccggaacgttacacagggtttc

SEQ ID NO: 3218 - DNA, 50 bp, Artificial
  Synthetic
gtgcatctcgtgctcaatcgcttcacgctctgccgcactcagctcaaaag

SEQ ID NO: 3219 - DNA, 50 bp, Artificial
  Synthetic
ccatgccgtgtaagtcaaacagcatgacgtaaggtttcggcagtttcttt

SEQ ID NO: 3220 - DNA, 50 bp, Artificial
  Synthetic
gcgccgtgttttgcggcctgctgttcgatcaattccagtgcccgttggca

SEQ ID NO: 3221 - DNA, 50 bp, Artificial
  Synthetic
tcaccctcgatatacaggttgccttcaccgcaaccgcatgttgtacacat

SEQ ID NO: 3222 - DNA, 50 bp, Artificial
  Synthetic
cggtaccacccgacgatactgattctctaccttgctgtgggccgctattt

SEQ ID NO: 3223 - DNA, 50 bp, Artificial
  Synthetic
agtcaccaccaccggcaatggtcccgccggttgctaaaatggtgatattg

SEQ ID NO: 3224 - DNA, 50 bp, Artificial
  Synthetic
gtttcggcaggtcgagattttcataaggcacacccgtcagtaccagaacc

SEQ ID NO: 3225 - DNA, 50 bp, Artificial
  Synthetic
acgggtaatggattcggaacgggagagtaacaattgaccggcaggtgtta

SEQ ID NO: 3226 - DNA, 50 bp, Artificial
  Synthetic
cgttcctgaacttcactcaacagttgttcgcgttcttcttctaatagctg

SEQ ID NO: 3227 - DNA, 50 bp, Artificial
  Synthetic
catatcttccagctcctgagtcgatgccttctccagattctcaatcactg

SEQ ID NO: 3228 - DNA, 50 bp, Artificial
  Synthetic
tttctgaccgaagttataacgcccggtgtcacctacttcctcgttgacga

SEQ ID NO: 3229 - DNA, 50 bp, Artificial
  Synthetic
aacatggtcgttcgggttcaggtactgatattcacctttctggtgaccca

SEQ ID NO: 3230 - DNA, 50 bp, Artificial
  Synthetic
aaagtcgacgaatcccgcccaggcttccgggccatttttcagggcaaaca

SEQ ID NO: 3231 - DNA, 50 bp, Artificial
  Synthetic
acgttgttaaccatcatgccgcaggaaccacaaatcgccatacggcagga

SEQ ID NO: 3232 - DNA, 50 bp, Artificial
  Synthetic
tttcgccagttcgcagatgaacggcagacgttcatgcagttttttctcgc

SEQ ID NO: 3233 - DNA, 50 bp, Artificial
  Synthetic
aaacatcacgctgtacttcttcgtcctggaagcggcggccaatcaggcgt

SEQ ID NO: 3234 - DNA, 50 bp, Artificial
  Synthetic
cgcgcgccgcacgttgacgaccacgtccgccgccaaaaatatcgccgaaa

SEQ ID NO: 3235 - DNA, 50 bp, Artificial
  Synthetic
gcgatgataatgatggccccaagatcgtcgataatagccagagccatcaa

SEQ ID NO: 3236 - DNA, 50 bp, Artificial
  Synthetic
ttttcaccatgttgctcgggatagcaaaaccgataccgatgttgccgccg

SEQ ID NO: 3237 - DNA, 50 bp, Artificial
  Synthetic
atcgaccgattgaccggtaaactccagacgcagcatcggcacgcagtcag

SEQ ID NO: 3238 - DNA, 50 bp, Artificial; identical to SEQ ID NO: 3128
  Synthetic

SEQ ID NO: 3239 - DNA, 50 bp, Artificial
  Synthetic
tcgtatttatttttctcgataacacgctccagcgtgtcaattgtctggca

SEQ ID NO: 3240 - DNA, 50 bp, Artificial
  Synthetic
gcatggcgctgtaccacttcaaccacctgatcaaccagctcaggtaacgc

SEQ ID NO: 3241 - DNA, 50 bp, Artificial
  Synthetic
gatgcaggaagttatagccgatattttcgacaaagggtcggtcgtgcgga

SEQ ID NO: 3242 - DNA, 50 bp, Artificial
  Synthetic
atcggcgttcgtaccgtgaagcaaataaacgccgccataggccgccagac

SEQ ID NO: 3243 - DNA, 50 bp, Artificial
  Synthetic
tcaatgcctgctggcgagcgcgtgtttcgctcaatttgttttccagctcg

SEQ ID NO: 3244 - DNA, 50 bp, Artificial
  Synthetic
gctgctcactttgcgacaattcactgcgaccagaacgattgctgtaatgc

SEQ ID NO: 3245 - DNA, 50 bp, Artificial
  Synthetic
aagaaaatcgacagcaccaccaggatacgcaccagttttaccggtacatc

SEQ ID NO: 3246 - DNA, 50 bp, Artificial; identical to SEQ ID NO: 3066
  Synthetic

SEQ ID NO: 3247 - DNA, 50 bp, Artificial
  Synthetic
gccgcggtaatatccagcggagacagatactcgttaagcagacgatcttt

SEQ ID NO: 3248 - DNA, 50 bp, Artificial
  Synthetic
tgaccggtttcttttttaaacatccgttgcaggtgccatttggagtaacc

SEQ ID NO: 3249 - DNA, 50 bp, Artificial
  Synthetic
gatccctttaacggcctgagaaagcgcactaaaggcagccagcaccgccg

SEQ ID NO: 3250 - DNA, 50 bp, Artificial; identical to SEQ ID NO: 3140
  Synthetic

SEQ ID NO: 3251 - DNA, 50 bp, Artificial
  Synthetic
ctgtcaggctcagtaccagcccgaaaacgaccattacggccaggttcgtt

SEQ ID NO: 3252 - DNA, 50 bp, Artificial
  Synthetic
atcaaagcgtcgtttaatgtcattggcatgggctcgtgcatgggcatcct

SEQ ID NO: 3253 - DNA, 50 bp, Artificial
  Synthetic
ggcaaggtgcgttatcattttgttttaattttgccagttcatcggcgtat

SEQ ID NO: 3254 - DNA, 50 bp, Artificial
  Synthetic
tatcaccatccgggctaagcaatttaagcgccaccaggctgttgtcaccg

SEQ ID NO: 3255 - DNA, 50 bp, Artificial
  Synthetic
agccacatcccatttggtggcggaataacgttgttgacgcgaaccgccat

SEQ ID NO: 3256 - DNA, 50 bp, Artificial
  Synthetic
gcctggtccacgtacgctggaaaccagaccatttttacgcagacgggaaa

SEQ ID NO: 3257 - DNA, 50 bp, Artificial; identical to SEQ ID NO: 3145
  Synthetic

SEQ ID NO: 3258 - DNA, 50 bp, Artificial
  Synthetic
cgcagaggcactcagtccggtaatgcgcgtcagctctcccgcgctggtgc

SEQ ID NO: 3259 - DNA, 50 bp, Artificial; identical to SEQ ID NO: 3151
  Synthetic

SEQ ID NO: 3260 - DNA, 50 bp, Artificial
  Synthetic
tggcaacgccccccagcaaattgctgtggtgagcgccaaaagaatgccaa

SEQ ID NO: 3261 - DNA, 50 bp, Artificial
  Synthetic
agcgcagcaaaatccgtcagccagggtgaacgatgtaatgtgtgcagcat

SEQ ID NO: 3262 - DNA, 50 bp, Artificial
  Synthetic
acgtcgtgatattgctggcgcatatattccatcgcttcctgtggcgtaac

SEQ ID NO: 3263 - DNA, 50 bp, Artificial
  Synthetic
accgtgcgttcgtcatttccctggcgcagagtgagcgtggcattcagctc

SEQ ID NO: 3264 - DNA, 50 bp, Artificial
  Synthetic
ataaagtaatcttccaggcaggccgccagggtatcaccttccagaccaac

SEQ ID NO: 3265 - DNA, 50 bp, Artificial
  Synthetic
aaccgcaggtgagacaggatcagcgttttagctgcttccagatcgccatg

SEQ ID NO: 3266 - DNA, 50 bp, Artificial
  Synthetic
ccgctgcacgctaagcactggttggtcgcttaaacggtagatctcttctg

SEQ ID NO: 3267 - DNA, 50 bp, Artificial
  Synthetic
gtaatgcggtagtggttatcgtcgcttttctcaatgttgtacggcgggaa

SEQ ID NO: 3268 - DNA, 50 bp, Artificial
  Synthetic
gcggtaatggttttcgtctaccagttcaacgttatacggagggtagccgc

SEQ ID NO: 3269 - DNA, 50 bp, Artificial
  Synthetic
ataaccgagctgcttcgggctgacatcaatacgcgccccggtaatgatcc

SEQ ID NO: 3270 - DNA, 50 bp, Artificial; identical to SEQ ID NO: 3165
  Synthetic

SEQ ID NO: 3271 - DNA, 50 bp, Artificial
  Synthetic
aaactggtgagacagggcggattgcgtctgatgcaacgtcgccgcagcgg

SEQ ID NO: 3272 - DNA, 50 bp, Artificial
  Synthetic
aacagttcgaacagcgtaaaagcatccgcagtaccgcccgcaaagcccgc

SEQ ID NO: 3273 - DNA, 50 bp, Artificial
  Synthetic
caccgatacaaacttcggtttcaggctgctaaggcgatcgatggagttcc

SEQ ID NO: 3274 - DNA, 50 bp, Artificial; identical to SEQ ID NO: 3171
  Synthetic

SEQ ID NO: 3275 - DNA, 50 bp, Artificial; identical to SEQ ID NO: 3172
  Synthetic

SEQ ID NO: 3276 - DNA, 50 bp, Artificial; identical to SEQ ID NO: 3178
  Synthetic

SEQ ID NO: 3277 - DNA, 50 bp, Artificial
  Synthetic
agcagcgacatcaaatccatgcccgccagcatcccgacggacagcgccgc

SEQ ID NO: 3278 - DNA, 50 bp, Artificial
  Synthetic
ttatcttcacgcatggtggagcgcagatgggtgaagtaaatacgcggacc

SEQ ID NO: 3279 - DNA, 50 bp, Artificial
  Synthetic
tctgctgacgctgatgttcggttaaacttatgccgtcgaacatatggctc

SEQ ID NO: 3280 - DNA, 50 bp, Artificial
  Synthetic
atgcttctatcgcattatcctttatctgccctttagtatgctgatatcgg

SEQ ID NO: 3281 - DNA, 50 bp, Artificial
  Synthetic
agtaaactcgctgattggttttcccgacagcatgacttaaatattggtcc

SEQ ID NO: 3282 - DNA, 50 bp, Artificial
  Synthetic
ggtcgacactatcggcccaatattcttgcgaagggttatagtgcaaaatc

SEQ ID NO: 3283 - DNA, 50 bp, Artificial
  Synthetic
acaccttcgctagcatcaagttgtaaacgtaatggatctgccttattcgt

SEQ ID NO: 3284 - DNA, 50 bp, Artificial
  Synthetic
ctgaatcttcggtaattgttgatgcacttcatcaagtaaccgtgtcagga

SEQ ID NO: 3285 - DNA, 50 bp, Artificial
  Synthetic
ctttcaacaactttagctagatcaattaccccataaccagctgcattagc

SEQ ID NO: 3286 - DNA, 50 bp, Artificial
  Synthetic
gaacagtcgttgggtaacaacccggattaccaatgacttgagcttgctta

SEQ ID NO: 3287 - DNA, 50 bp, Artificial
  Synthetic
ttcttcagaaactacttcagcttgacgcacagcatcattcaccgcagctg

SEQ ID NO: 3288 - DNA, 50 bp, Artificial
  Synthetic
cttaatgctgcttttcgctggctttccgcagccacttcattaacatctac

SEQ ID NO: 3289 - DNA, 50 bp, Artificial
  Synthetic
gttcacgccatcccaaacatcttcagccgaaagtttaagattacgtggta

SEQ ID NO: 3290 - DNA, 50 bp, Artificial
  Synthetic
tattggcaggttcaagctcagataagctgtctgcaacgagttgactggtc

SEQ ID NO: 3291 - DNA, 50 bp, Artificial
  Synthetic
atcaccgcggaatttaaccttacctgcttccattggtccgccagacacaa

SEQ ID NO: 3292 - DNA, 50 bp, Artificial
  Synthetic
gcaacttgaggaatccagtcaactgggatcaagtccattaagttcatgag

SEQ ID NO: 3293 - DNA, 50 bp, Artificial
  Synthetic
tacgagtttgaagttgtggagctaattctggttgacgagcaacagcttct

SEQ ID NO: 3294 - DNA, 50 bp, Artificial
  Synthetic
agtacgagcttcttcgatcaattgcgctgcacgacggttcgcttgttcga

SEQ ID NO: 3295 - DNA, 50 bp, Artificial
  Synthetic
cacctgcaataagctcaggtttaacttcaactgaaacagttactgtgctg

SEQ ID NO: 3296 - DNA, 50 bp, Artificial
  Synthetic
ttgaacaggttggtctacagattgacgccaaattacacctggtgctactt

SEQ ID NO: 3297 - DNA, 50 bp, Artificial
  Synthetic
gataagctgacctgcgttatctgtcgctgctttcattgcgaccatacgtg

SEQ ID NO: 3298 - DNA, 50 bp, Artificial
  Synthetic
tcggcaggtacatatactgcttggatcgaagtgatcgaaccagatttagt

SEQ ID NO: 3299 - DNA, 50 bp, Artificial
  Synthetic
attgtcagcacggattgcagtatctgcaagaaccgtcacaacatgaggtt

SEQ ID NO: 3300 - DNA, 50 bp, Artificial
  Synthetic
acgcagtacgagccatatccatgatacggtcaacaccagcaataaatgct

SEQ ID NO: 3301 - DNA, 50 bp, Artificial
  Synthetic
tttcttttactgcccccacataatcggcatcatcatgttgaatatggtta

SEQ ID NO: 3302 - DNA, 50 bp, Artificial
  Synthetic
gattgtagtgtccgtttgcatctaacatgagggaaggatgcaccagtaaa

SEQ ID NO: 3303 - DNA, 50 bp, Artificial
  Synthetic
gctgacatgttagaacctagggcaactaaccaagttactcctagatgttg

SEQ ID NO: 3304 - DNA, 50 bp, Artificial
  Synthetic
atgattgccatagggtgagcatcacgacggaaaccattgaagaaacggct

SEQ ID NO: 3305 - DNA, 50 bp, Artificial
  Synthetic
cgaaacattcaccttcccaaaggctttcatcaggaggagtttcttctaaa

SEQ ID NO: 3306 - DNA, 50 bp, Artificial
  Synthetic
tgtgattggtacttctttaccttggtcattcaacatatagcagctattga

SEQ ID NO: 3307 - DNA, 50 bp, Artificial
  Synthetic
ctcactatatcgacgtccatcgttacggtcataacgatcgtcatcatgat

SEQ ID NO: 3308 - DNA, 50 bp, Artificial
  Synthetic
ctttcgggccatgtcctcggtcaaaaggaggatcagcaaagcttgccata

SEQ ID NO: 3309 - DNA, 50 bp, Artificial
  Synthetic
agccgtcaatacttgtgcgatttctttcatgttggcacggatcaagtctt

SEQ ID NO: 3310 - DNA, 50 bp, Artificial
  Synthetic
tgccatgccttcggccaccgcagccattgaaattcctaaaatcaggttat

SEQ ID NO: 3311 - DNA, 50 bp, Artificial
  Synthetic
tgttttaaaccatgatgattacacaccaccatgcctacttcagtttgccc

SEQ ID NO: 3312 - DNA, 50 bp, Artificial
  Synthetic
cttcacctgtgtagaacgggtgtgatgcacttgaaatatcaagagtcaca

SEQ ID NO: 3313 - DNA, 50 bp, Artificial
  Synthetic
gaaacactagagttggtccgtaagccttgtttattcgcggttaaatcagc

SEQ ID NO: 3314 - DNA, 50 bp, Artificial
  Synthetic
gcacaccaatttcttgcgtacgttcagtcaccgaaaccagcataatattc

SEQ ID NO: 3315 - DNA, 50 bp, Artificial
  Synthetic
gaactacacttagtgttgctttgccttgttcaataagttgtttttgttca

SEQ ID NO: 3316 - DNA, 50 bp, Artificial
  Synthetic
ttgggcaatgttctgtaccaaaaagcgtggcatatctgtgccattaatca

SEQ ID NO: 3317 - DNA, 50 bp, Artificial
  Synthetic
tcggcagtcaaataactatcttcatcgataatttttttcaacttagaacg

SEQ ID NO: 3318 - DNA, 50 bp, Artificial
  Synthetic
atacgtgctttatcaagttcaacctgagcttgtttagtgccttctaccag

SEQ ID NO: 3319 - DNA, 50 bp, Artificial
  Synthetic
ggaatcgaatatttattgaggtgagggtggttacgtagtttttggcctgt

SEQ ID NO: 3320 - DNA, 50 bp, Artificial
  Synthetic
ccagtcaatctcgccaaactcatagtggcctgtttcttcattgaacttta

SEQ ID NO: 3321 - DNA, 50 bp, Artificial
  Synthetic
agtcaccattgggttgttcgcacaacaagaggtttaaaaactcacgttct

SEQ ID NO: 3322 - DNA, 50 bp, Artificial
  Synthetic
agttgaaagcgttctttgaactgatctttcaaatccataatttgctcggc

SEQ ID NO: 3323 - DNA, 50 bp, Artificial
  Synthetic
agttgaaccgcatattcaacggttaattcggtcggaaccacttgactgca

SEQ ID NO: 3324 - DNA, 50 bp, Artificial
  Synthetic
gaatgcttcattcagctcaatcacatccatctgatctagcgttaaacctg

SEQ ID NO: 3325 - DNA, 50 bp, Artificial
  Synthetic
gcacaatttgctcttgcggtacggcaaacataccaaacggatagttgtct

SEQ ID NO: 3326 - DNA, 50 bp, Artificial
  Synthetic
acttgcatggcaagcggtacaatatttttagggagctgtgctacatactc

SEQ ID NO: 3327 - DNA, 50 bp, Artificial
  Synthetic
ttctctttataagcagttttcgccacttttgcagagttttcataaccaat

SEQ ID NO: 3328 - DNA, 50 bp, Artificial
  Synthetic
gtgccatcttgcccgtattcccgacaatcatgccaagcacacttgcaatt

SEQ ID NO: 3329 - DNA, 50 bp, Artificial
  Synthetic
atttttcactgaaccagcgggtatgggtagttttaactagctcggctaaa

SEQ ID NO: 3330 - DNA, 50 bp, Artificial
  Synthetic
aaccacgagtcccatgaagtaagtcacccaaagcaaaaccgtacctttgg

SEQ ID NO: 3331 - DNA, 50 bp, Artificial
  Synthetic
cccgcatagagtgaactgtgtaagatcagctcttttaaatcttctttagt

SEQ ID NO: 3332 - DNA, 50 bp, Artificial
  Synthetic
cgtttggatggcggtaacgaccagaagcattggcttgccatacttctaga

SEQ ID NO: 3333 - DNA, 50 bp, Artificial
  Synthetic
atgctatttagaattggatcgttagcatttgcctctgcttcatcttcaaa

SEQ ID NO: 3334 - DNA, 50 bp, Artificial
  Synthetic
caaagcccttcttcacccatgcttgggataaacgccaaattttcccgcga

SEQ ID NO: 3335 - DNA, 50 bp, Artificial
  Synthetic
tttgctttttcttgtacatacacatgccaatcgcaatacctgttcctaat

SEQ ID NO: 3336 - DNA, 50 bp, Artificial
  Synthetic
ctctacataaaacgttaatgaaccagcagaagtgtatccaaccactaata

SEQ ID NO: 3337 - DNA, 50 bp, Artificial
  Synthetic
attgccacaaaaccttgtggattgagttctacacctaaacgttctagtcc

SEQ ID NO: 3338 - DNA, 50 bp, Artificial
  Synthetic
aactgtttaatgcctaacattcctaaatttgaaatgctaaagctaccacc

SEQ ID NO: 3339 - DNA, 50 bp, Artificial
  Synthetic
gccacgtacaaccattggtgcttttgcttttccgccaaacatataacgga

SEQ ID NO: 3340 - DNA, 50 bp, Artificial
  Synthetic
accacccacaatcccgttggcaccgagcatacctttatctaaatcggcaa

SEQ ID NO: 3341 - DNA, 50 bp, Artificial
  Synthetic
cagcttttagtgtagtggtactcactggtcgatcgccatataaggcatag

SEQ ID NO: 3342 - DNA, 50 bp, Artificial
  Synthetic
cctggcgcaataccgtcttcttcatttaacagtttgatttcatcagtcac

SEQ ID NO: 3343 - DNA, 50 bp, Artificial
  Synthetic
cagtgcctgcacttttttatttggtaatttcactttacctaaggcgtcat

SEQ ID NO: 3344 - DNA, 50 bp, Artificial
  Synthetic
taccaacagtataacctgcaccgccacctaaaccaccgccaattgcagat

SEQ ID NO: 3345 - DNA, 50 bp, Artificial
  Synthetic
accgcctaaagcaccaccaatagccgcttctgtacggttacgacggtcgc

SEQ ID NO: 3346 - DNA, 50 bp, Artificial
  Synthetic
ataagaactccgattccccaaaaaagcggacatttaccaagttaatgccg

SEQ ID NO: 3347 - DNA, 50 bp, Artificial
  Synthetic
gcggtcaatttcagaagctgcatttgcaggagttaaacgagtttgggcaa

SEQ ID NO: 3348 - DNA, 50 bp, Artificial
  Synthetic
catctggatgagaagataatgcttcaccaatctcaccagcaccaaccaca

SEQ ID NO: 3349 - DNA, 50 bp, Artificial
  Synthetic
aattggataagtgctttgggcaccagtttccactttcacttgtgggtatt

SEQ ID NO: 3350 - DNA, 50 bp, Artificial
  Synthetic
gcatttgcacccgaagataaagaaatacccaaacctgcggcaggatagcc

SEQ ID NO: 3351 - DNA, 50 bp, Artificial
  Synthetic
tgagaggtatctgcaacccattgacgtcgtgattcttcatgctgatgtaa

SEQ ID NO: 3352 - DNA, 50 bp, Artificial
  Synthetic
ttttgaatttgctcaaaacgagctttacgctctgcacggtgttgttccca

SEQ ID NO: 3353 - DNA, 50 bp, Artificial
  Synthetic
cacctgcattaacgcccgcactttgtgcaaaaatagaggcagaagcaagt

SEQ ID NO: 3354 - DNA, 50 bp, Artificial
  Synthetic
acagaactacggacaatcactgaggtcactggcattccgccaattaaacc

SEQ ID NO: 3355 - DNA, 50 bp, Artificial
  Synthetic
acctggttggccgttgacggttgtagtcacttttactttagataagcttt

SEQ ID NO: 3356 - DNA, 50 bp, Artificial
  Synthetic
taggaacgaagtactcaacgcctacgccatattgagtgtcttttgtgccg

SEQ ID NO: 3357 - DNA, 50 bp, Artificial
  Synthetic
ttgggcttattggtttggtcatcaatcgttttccataccgttccgtttag

SEQ ID NO: 3358 - DNA, 50 bp, Artificial
  Synthetic
tcatgtacaggcttgataatgacaggcaaccccaattcagcaatcactga

SEQ ID NO: 3359 - DNA, 50 bp, Artificial
  Synthetic
aactgccagattggtaatacctgcaccaatatcgacaagacagacaccat

SEQ ID NO: 3360 - DNA, 50 bp, Artificial
  Synthetic
tgcatttccaagccttcgataccttgaccttcactattggtcaaaccaat

SEQ ID NO: 3361 - DNA, 50 bp, Artificial
  Synthetic
aaggtcagcatctcttgcaactaggccatccatattttcttcaagccaaa

SEQ ID NO: 3362 - DNA, 50 bp, Artificial
  Synthetic
gagctcataaagcgcctgaccttcacgaacatagcttccttcagcaaata

SEQ ID NO: 3363 - DNA, 50 bp, Artificial
  Synthetic
ttgagcagttaacataccttgcaattgggtaaaaggtgcaactcctgtca

SEQ ID NO: 3364 - DNA, 50 bp, Artificial
  Synthetic
ttggacatccaccatatcaagcggttttccagattttactaagccaatga

SEQ ID NO: 3365 - DNA, 50 bp, Artificial
  Synthetic
cagctttttcttcaatagtttctgcgcttacaagcattcgtggaaactgg

SEQ ID NO: 3366 - DNA, 50 bp, Artificial
  Synthetic
cctgatttggaccatgatatggatcttgccctaatataacgactttcaca

SEQ ID NO: 3367 - DNA, 50 bp, Artificial
  Synthetic
tggaacatcttttacatatagttttgttccgcgcgtaacaccgcgcccag

SEQ ID NO: 3368 - DNA, 50 bp, Artificial
  Synthetic
tgctgaaacttagacggtctacctttagcagtgatcgtttgaatttcacg

SEQ ID NO: 3369 - DNA, 50 bp, Artificial
  Synthetic
ttttgtcctttacggcggtgttcataacgcattaaggtttgttcatgtgc

SEQ ID NO: 3370 - DNA, 50 bp, Artificial
  Synthetic
atgctgaagcaatgtgtgaaggtaataaacggcctaatggttgaggcgct

SEQ ID NO: 3371 - DNA, 50 bp, Artificial
  Synthetic
cttcatcgaaacgggcacgtaattcaattaccgccgtcacttctttacca

SEQ ID NO: 3372 - DNA, 50 bp, Artificial
  Synthetic
aaacaggcataagctgacgctgagcaagttgttctctagccaactgcaca

SEQ ID NO: 3373 - DNA, 50 bp, Artificial
  Synthetic
ggttggcaacactgcgcaatatgtagctcaacattgtctaaaccatcaat

SEQ ID NO: 3374 - DNA, 50 bp, Artificial
  Synthetic
tgagttttgacccagtcacggaccgttactaacgggaaatctggaccata

SEQ ID NO: 3375 - DNA, 50 bp, Artificial
  Synthetic
aaacagaaacttccggagaaacttgtccttttgccgccatatgctcttca

SEQ ID NO: 3376 - DNA, 50 bp, Artificial
  Synthetic
gcctcaatactcaagtccagctcatttaaaatgatttggcggtagtcttg

SEQ ID NO: 3377 - DNA, 50 bp, Artificial
  Synthetic
gtttctgctgcacgctccgcaatacttggcataccttgatcgcttaaatc

SEQ ID NO: 3378 - DNA, 50 bp, Artificial
  Synthetic
aacaagatactggcatctagtcgcccctgtgccgccacaccaaagtattt

SEQ ID NO: 3379 - DNA, 50 bp, Artificial
  Synthetic
attgtggtgtagcacggaaaataatcggagtcttatgacgccagcagtgt

SEQ ID NO: 3380 - DNA, 50 bp, Artificial
  Synthetic
ctttgttgtagcccacaagtagcataaagcccacataaagcactaacatg

SEQ ID NO: 3381 - DNA, 50 bp, Artificial
  Synthetic
catcaatcgggtttgcggcaagtttacctggtcccataatttttgcagca

SEQ ID NO: 3382 - DNA, 50 bp, Artificial
  Synthetic
agccaccaataacccctgcaatcgagatcatggttaagtggcgtgattta

SEQ ID NO: 3383 - DNA, 50 bp, Artificial
  Synthetic
ataacgtaaatattttcctttttaaaaccgtgagtcaagaagaggttcgc

SEQ ID NO: 3384 - DNA, 50 bp, Artificial
  Synthetic
aataacttctgcctgatttgctggctgagcatagttaagctcagctgaaa

SEQ ID NO: 3385 - DNA, 50 bp, Artificial
  Synthetic
cacggaaattcaaaccatgtagtgctttaaccgactcacgcttttggtca

SEQ ID NO: 3386 - DNA, 50 bp, Artificial
  Synthetic
ttgaatcacttgcgccgagcctaaaaataatccggtaccaattgctccac

SEQ ID NO: 3387 - DNA, 50 bp, Artificial
  Synthetic
ccagcctttatctaaatttgaacccgcttggacataagtttgtacctgcc

SEQ ID NO: 3388 - DNA, 50 bp, Artificial
  Synthetic
ccatgaaattgacgaccataccacgatgccatgccagtttggctaaactt

SEQ ID NO: 3389 - DNA, 50 bp, Artificial
  Synthetic
gattgtactaatgcctgtaaccactgttccaagccatacaattgccatca

SEQ ID NO: 3390 - DNA, 50 bp, Artificial
  Synthetic
atggtatcttcatcaatttcagagatgccgccttcttgagcacgaataca

SEQ ID NO: 3391 - DNA, 50 bp, Artificial
  Synthetic
caataaagtcacagccattttcgttataggcattcacaccgttgtggaca

SEQ ID NO: 3392 - DNA, 50 bp, Artificial; identical to SEQ ID NO: 3302
  Synthetic

SEQ ID NO: 3393 - DNA, 50 bp, Artificial
  Synthetic
tagcataagccaagcgccgccatgagcacacaacatagaaaggctgacaa

SEQ ID NO: 3394 - DNA, 50 bp, Artificial; identical to SEQ ID NO: 3303
  Synthetic

SEQ ID NO: 3395 - DNA, 50 bp, Artificial
  Synthetic
ataccaattgaattttcaaccaaagctttacagtgttcagggttcgccgt

SEQ ID NO: 3396 - DNA, 50 bp, Artificial
  Synthetic
aataccatcaactcttgaatacggctttccatgaggtcagctgcgcgttt

SEQ ID NO: 3397 - DNA, 50 bp, Artificial
  Synthetic
gcgccaggttggaaaaagtttgctaaacccataccgatggcaagtgagac

SEQ ID NO: 3398 - DNA, 50 bp, Artificial
  Synthetic
tgatcagtgtattcataccgaggcgttgataaagagggagcatggctgcc

SEQ ID NO: 3399 - DNA, 50 bp, Artificial
  Synthetic
ctttgcgcttcatctacgttgttatatgggctagacattaacgctactgc

SEQ ID NO: 3400 - DNA, 50 bp, Artificial
  Synthetic
ggcatccggtaaccagccatgcaatgggaaaactggtaacttcactgcaa

SEQ ID NO: 3401 - DNA, 50 bp, Artificial
  Synthetic
accaacggtacacaccattcacagcaaattttttgacaaggtcttcacct

SEQ ID NO: 3402 - DNA, 50 bp, Artificial
  Synthetic
cccatcgcaaacaaaaataagttaaccgcatagcccagcactgctaagcc

SEQ ID NO: 3403 - DNA, 50 bp, Artificial
  Synthetic
taagtcagcatggctgctttttcttgtttaattctcggtgcaatctttaa

SEQ ID NO: 3404 - DNA, 50 bp, Artificial
  Synthetic
ctttcagtattttctgtgctaagagagtggaccaaaatatcaccacgctc

SEQ ID NO: 3405 - DNA, 50 bp, Artificial
  Synthetic
attttttgattacgctgatcacggatgtccacttgtagctgtccgttctg

SEQ ID NO: 3406 - DNA, 50 bp, Artificial
  Synthetic
tgtaagcgttttaactcttcaacagataattcactaatatccggtttcat

SEQ ID NO: 3407 - DNA, 50 bp, Artificial
  Synthetic
acggcctgttaggcgtaagtagtcgattgtgttttggtcgatgtagaaca

SEQ ID NO: 3408 - DNA, 50 bp, Artificial
  Synthetic
atgtcatagccacgatagtgcaagtcgttaccgctacgtcctacggtaca

SEQ ID NO: 3409 - DNA, 50 bp, Artificial
  Synthetic
cggataaagcgcaaggcttacatcggcagatgctaactcttcagtggtaa

SEQ ID NO: 3410 - DNA, 50 bp, Artificial
  Synthetic
aactctttgttcattgcttgctctaccgctggttttacctcacttgatac

SEQ ID NO: 3411 - DNA, 50 bp, Artificial
  Synthetic
cacttccaatagcccccaaaaaaacatccctgcaagcataaaaccaagcc

SEQ ID NO: 3412 - DNA, 50 bp, Artificial
  Synthetic
tctgaaacctgtgctactacctgttccggagatctatttaaatctggcaa

SEQ ID NO: 3413 - DNA, 50 bp, Artificial
  Synthetic
acatcttcagccgaaagtttaagattacgtggtaataaattacgtaactc

SEQ ID NO: 3414 - DNA, 50 bp, Artificial
  Synthetic
ctgaacctgaaacacccgtgacacaagtcataatgccaagtgggatggtt

SEQ ID NO: 3415 - DNA, 50 bp, Artificial
  Synthetic
aagttgtgttgtacacggtagccttcaaagtgctggattgaaccgtcgtc

SEQ ID NO: 3416 - DNA, 50 bp, Artificial
  Synthetic
aaacctgcttcatggatcagttcaggcgatgcacccggaattgtttttag

SEQ ID NO: 3417 - DNA, 50 bp, Artificial
  Synthetic
aaatgcggctgaatgagtggtaagacattaaaatcaggacgaaccagact

SEQ ID NO: 3418 - DNA, 50 bp, Artificial
  Synthetic
aaattgaatctgaggcagggccgcagcgctagaagttccttgtgccaaag

SEQ ID NO: 3419 - DNA, 50 bp, Artificial
  Synthetic
agacgcttcataacacggccacgcaatgccgaaattttttgttgccatgt

SEQ ID NO: 3420 - DNA, 50 bp, Artificial
  Synthetic
cctgcttggttactttcattcggcattggaaatggcaatttcaccaaagc

SEQ ID NO: 3421 - DNA, 50 bp, Artificial
  Synthetic
aaacgaggttcgatttttcgccatgctttccatacaggttgtacaaatat

SEQ ID NO: 3422 - DNA, 50 bp, Artificial
  Synthetic
ctgatgtctgttgcatgaggtcttccataattaatggatctaaggtgatg

SEQ ID NO: 3423 - DNA, 50 bp, Artificial
  Synthetic
aaagcatatgagcgtaaacgttggccagtaagaggagggcgctgctgaga

SEQ ID NO: 3424 - DNA, 50 bp, Artificial
  Synthetic
ttgtagacccatatgagagtcacccatctcaccttcgatttctgctttag

SEQ ID NO: 3425 - DNA, 50 bp, Artificial
  Synthetic
aactcggtttttggaaaattgtttcatgacgggcgttataagtatgtttt

SEQ ID NO: 3426 - DNA, 50 bp, Artificial
  Synthetic
cgcagcaacacgttctgtcgccaaaggaatgtggtaaattttatcgttgt

SEQ ID NO: 3427 - DNA, 50 bp, Artificial
  Synthetic
tacaatcagatcgacctctccacggcgtgaatgataattactggcgaccc

SEQ ID NO: 3428 - DNA, 50 bp, Artificial
  Synthetic
ttacaatcaccatgtcggcgccttcttgaatatcaagcgcgatttcatgt

SEQ ID NO: 3429 - DNA, 50 bp, Artificial
  Synthetic
cccatttagagagcatcgcgttgtcacgcattgcaccataaatgtcataa

SEQ ID NO: 3430 - DNA, 50 bp, Artificial
  Synthetic
gtggtttgcacaaccatctagatatttttgccaagcccactcatatttaa

SEQ ID NO: 3431 - DNA, 50 bp, Artificial
  Synthetic
atgggtgcggaaaatgacgcttgatcatcatgatatggtggtttagtcat

SEQ ID NO: 3432 - DNA, 50 bp, Artificial
  Synthetic
ttggttttcccgacagcatgacttaaatattggtccccagcacggtagtt

SEQ ID NO: 3433 - DNA, 50 bp, Artificial
  Synthetic
tatttaaagttgttgtggtgtgctcctcttttttggcacaaccacctagc

SEQ ID NO: 3434 - DNA, 50 bp, Artificial
  Synthetic
ttgagggccagcggggaactcattccaagtgattttggcatttggaaatt

SEQ ID NO: 3435 - DNA, 50 bp, Artificial
  Synthetic
tgctttactgtttccggcgtagcaatgatctgtacattcgggaaatactg

SEQ ID NO: 3436 - DNA, 50 bp, Artificial
  Synthetic
gggcaatttcgcttgcatatgttttgtcttgaaactggatttcagttggg

SEQ ID NO: 3437 - DNA, 50 bp, Artificial
  Synthetic
taaagtcgagttcatgtggtttggtaatcgtacggcataagtctgccatg

SEQ ID NO: 3438 - DNA, 50 bp, Artificial
  Synthetic
gtgccatattgagctagacgaatacgttcttcattgtcatctagcataca

SEQ ID NO: 3439 - DNA, 50 bp, Artificial
  Synthetic
aaacttggctttggccatagttctcatcatattgagaaactgctttaggc

SEQ ID NO: 3440 - DNA, 50 bp, Artificial
  Synthetic
attggaacccccatcggttctttatcaggtgtaccatgaatatagatata

SEQ ID NO: 3441 - DNA, 50 bp, Artificial
  Synthetic
gctttgacatggctagagccatagcatttggtccagttaaaccaattcct

SEQ ID NO: 3442 - DNA, 50 bp, Artificial
  Synthetic
cttttcagtttttgattgcaagtctttacggcgagtctctaaagatgccc

SEQ ID NO: 3443 - DNA, 50 bp, Artificial; identical to SEQ ID NO: 3363
  Synthetic

SEQ ID NO: 3444 - DNA, 50 bp, Artificial
  Synthetic
accctcaactgtaatgggtacatccatgaggtttgcagatcgtgacacga

SEQ ID NO: 3445 - DNA, 50 bp, Artificial; identical to SEQ ID NO: 3418
  Synthetic

SEQ ID NO: 3446 - DNA, 50 bp, Artificial
  Synthetic
gcgtcatgcaaagcagatgtactttgttcttcccaatcctcattttctac

SEQ ID NO: 3447 - DNA, 50 bp, Artificial
  Synthetic
taccaaatccgcacgacggcgcacttcctcatgtccgtttggaacagtaa

SEQ ID NO: 3448 - DNA, 50 bp, Artificial; identical to SEQ ID NO: 3284
  Synthetic

SEQ ID NO: 3449 - DNA, 50 bp, Artificial
  Synthetic
gaacttgctctaaagcatcatgaagtaatttactttgtgcataaaaagca

SEQ ID NO: 3450 - DNA, 50 bp, Artificial
  Synthetic
aaagttatgtgtaggctcgccatctttaccaatacccatgtcaccagttt

SEQ ID NO: 3451 - DNA, 50 bp, Artificial
  Synthetic
gtttaaagcaatagtttgcgagtctacaactgcacgcgttaaggtcactt

SEQ ID NO: 3452 - DNA, 50 bp, Artificial
  Synthetic
tctttttgggtgttttgtacagcgtgattaacttcaaataactctaattc

SEQ ID NO: 3453 - DNA, 50 bp, Artificial
  Synthetic
aatccattgctgcatcacgatccgcattgtcagcaaactgaacagtgatc

SEQ ID NO: 3454 - DNA, 50 bp, Artificial
  Synthetic
tcttcgccttctgtacggctgcttttcataacacgaatactttgcaagaa

SEQ ID NO: 3455 - DNA, 50 bp, Artificial
  Synthetic
acttcttgacgaagctttcgaatttcctctttatcagaagttgccgcatt

SEQ ID NO: 3456 - DNA, 50 bp, Artificial
  Synthetic
agttgccattgcaagaccagcaccgttaaccatacaaccgatgttacctt

SEQ ID NO: 3457 - DNA, 50 bp, Artificial
  Synthetic
ttggattttacccccatctaacgctaattcggtatttccagaagcatctg

SEQ ID NO: 3458 - DNA, 50 bp, Artificial
  Synthetic
cttgggtcagtgtaaagtaaagcattacggttaccttgtttgataccgtt

SEQ ID NO: 3459 - DNA, 50 bp, Artificial; identical to SEQ ID NO: 3303
  Synthetic

SEQ ID NO: 3460 - DNA, 50 bp, Artificial
  Synthetic
tacaggttcaggattttctgttccatctacaaagccaataatcgcacgcc

SEQ ID NO: 3461 - DNA, 50 bp, Artificial
  Synthetic
ataaagcttagtagactgatcgattggctcacggaagattgcgtctttca

SEQ ID NO: 3462 - DNA, 50 bp, Artificial
  Synthetic
ccttgtaccaaggagtatgagctgatggatttacaacgttatcgccattt

SEQ ID NO: 3463 - DNA, 50 bp, Artificial
  Synthetic
ggaatgaatacacacgctctttcgcacgtgatttttcttcgtcacggcgc

SEQ ID NO: 3464 - DNA, 50 bp, Artificial
  Synthetic
attttcttttactgcccccacataatcggcatcatcatgttgaatatggt

SEQ ID NO: 3465 - DNA, 50 bp, Artificial
  Synthetic
gcttcatctacgttgttatatgggctagacattaacgctactgcaccaaa

SEQ ID NO: 3466 - DNA, 50 bp, Artificial
  Synthetic
gagcatgggcatccggtaaccagccatgcaatgggaaaactggtaacttc

SEQ ID NO: 3467 - DNA, 50 bp, Artificial
  Synthetic
ctgccatcgcatctgctaaccatgtttgcaatggaatttgtgcagattta

SEQ ID NO: 3468 - DNA, 50 bp, Artificial
  Synthetic
atctggttgtgcccatacgctacccgcaagaacgaatgctaacgctgcag

SEQ ID NO: 3469 - DNA, 50 bp, Artificial
  Synthetic
caaccggacatgcaaccgcacaaaggttacatgccacacaacgctcttcc

SEQ ID NO: 3470 - DNA, 50 bp, Artificial
  Synthetic
agccattgccataaagaacaacaaaccgatgctcatgtccgcaacaccca

SEQ ID NO: 3471 - DNA, 50 bp, Artificial
  Synthetic
gcttgctgctgaaagtacaatatcagcctgtttcacagtttcagtttcac

SEQ ID NO: 3472 - DNA, 50 bp, Artificial
  Synthetic
acggcaacatcacatggaaacacaagcttagaaccgaattgctcagcaaa

SEQ ID NO: 3473 - DNA, 50 bp, Artificial
  Synthetic
cgacaccaagttgaataatggtgacgcgacgcaaatttacctttccagca

SEQ ID NO: 3474 - DNA, 50 bp, Artificial
  Synthetic
atttgtttctttaagccaacccaactcagcagtgcaagtaaagcaattgc

SEQ ID NO: 3475 - DNA, 50 bp, Artificial
  Synthetic
atgttgcctcaaactgacgaagcattcggacaagacccggatgcttttta

SEQ ID NO: 3476 - DNA, 50 bp, Artificial
  Synthetic
ataggggaagtatcctgaatttttcgttcgataaaaccgtctctctctaa

SEQ ID NO: 3477 - DNA, 50 bp, Artificial
  Synthetic
aatacccaaaggtcttcacggagttcgcgagatggagtgcggtctaacat

SEQ ID NO: 3478 - DNA, 50 bp, Artificial
  Synthetic
ttgcaacttcagggtctggacctgaatcaccttcagaatcatcatcacct

SEQ ID NO: 3479 - DNA, 50 bp, Artificial
  Synthetic
tttgaagttcaagcggcagattcggatgttgctgcatacattcattaagc

SEQ ID NO: 3480 - DNA, 50 bp, Artificial
  Synthetic
gatttctacaacatctctcgggaactgatcttctgtttcctgatgtccac

SEQ ID NO: 3481 - DNA, 50 bp, Artificial
  Synthetic
ctaaagcaccaccaatagccgcttctgtacggttacgacggtcgcttgct

SEQ ID NO: 3482 - DNA, 50 bp, Artificial; identical to SEQ ID NO: 3389
  Synthetic

SEQ ID NO: 3483 - DNA, 50 bp, Artificial
  Synthetic
accctcaaaaccaatcgcatgtaaaatccgcacagagatcgttctttccc

SEQ ID NO: 3484 - DNA, 50 bp, Artificial
  Synthetic
atatcaataatccataaaagctgattggcagttaaattcaatgctgcact

SEQ ID NO: 3485 - DNA, 50 bp, Artificial
  Synthetic
gccaaatccacacaaaataattgcaataagcatgtataaatcgccgatgc

SEQ ID NO: 3486 - DNA, 50 bp, Artificial; identical to SEQ ID NO: 3328
  Synthetic

SEQ ID NO: 3487 - DNA, 50 bp, Artificial; identical to SEQ ID NO: 3329
  Synthetic

SEQ ID NO: 3488 - DNA, 50 bp, Artificial; identical to SEQ ID NO: 3330
  Synthetic

SEQ ID NO: 3489 - DNA, 50 bp, Artificial
  Synthetic
gagaagggtcttgggcaataaaattaagtgtaacttcggcaagcgcacct

SEQ ID NO: 3490 - DNA, 50 bp, Artificial
  Synthetic
cttcctttcctaacggccctaaaagcccagcttcgaccgatagccccatt

SEQ ID NO: 3491 - DNA, 50 bp, Artificial
  Synthetic
tattccaagcggctaatagacaatgcgcctgttttaacatggtgcatagt

SEQ ID NO: 3492 - DNA, 50 bp, Artificial
  Synthetic
tgcaacagtttgaacgttgtctcggctaatgaggttggcaagagtgattt

SEQ ID NO: 3493 - DNA, 50 bp, Artificial
  Synthetic
gccgaattgttcgaaaatttgatcatgttcatcgatatcatctacaaatt

SEQ ID NO: 3494 - DNA, 50 bp, Artificial
  Synthetic
cgaaatcactaatagattgatcaagatgatgatcttgctttttaagagct

SEQ ID NO: 3495 - DNA, 50 bp, Artificial
  Synthetic
gacttcaatacgagcttggcctgcagtcattggtggaatgccatgaagta

SEQ ID NO: 3496 - DNA, 50 bp, Artificial
  Synthetic
aagtaaatcgtgagtggaatcgcaatacgtaatacatctaaaggtaagct

SEQ ID NO: 3497 - DNA, 50 bp, Artificial
  Synthetic
gctttaagactagtgaggcttaatgccaaaaaacctaagtcggccccgtc

SEQ ID NO: 3498 - DNA, 50 bp, Artificial
  Synthetic
aacatttctgtggaagttgcggttgccatttcttttagatctgcacctgc

SEQ ID NO: 3499 - DNA, 50 bp, Artificial
  Synthetic
ccggcaatagatgacatatttataatcacgcctgcctgtgcttgctttaa

SEQ ID NO: 3500 - DNA, 50 bp, Artificial
  Synthetic
aaggcttggcttggtttgtgagcaagtttaattgccacatcttcaaccac

SEQ ID NO: 3501 - DNA, 50 bp, Artificial
  Synthetic
aaggtatgtgtgaggcgagtaatggttggttttggcaaacctgtcatctg

SEQ ID NO: 3502 - DNA, 50 bp, Artificial
  Synthetic
tccatagtgatgcctaagccaccatattcttcgggaattgtaagaccgaa

SEQ ID NO: 3503 - DNA, 50 bp, Artificial
  Synthetic
aacttaaattttgatgcaacagaagcataatcttttttaagggtttgacc

SEQ ID NO: 3504 - DNA, 50 bp, Artificial
  Synthetic
gaatcttactttcctctttaacaatatacaaaactgaaccattggcattg

SEQ ID NO: 3505 - DNA, 50 bp, Artificial
  Synthetic
cgcaataagcgtgcttccagtgaaagcagtataggtgattttagtattca

SEQ ID NO: 3506 - DNA, 50 bp, Artificial
  Synthetic
gctgcggcaataccacttaccccaaacataaggccaaacattaaacctgc

SEQ ID NO: 3507 - DNA, 50 bp, Artificial
  Synthetic
cgttggtgtaatattcaaatgcaccacccaatggtgagttgacgtaccag

SEQ ID NO: 3508 - DNA, 50 bp, Artificial
  Synthetic
gttgacatataaatcatgacgttcctgtggcacatactcggttgcttcaa

SEQ ID NO: 3509 - DNA, 50 bp, Artificial
  Synthetic
catgctgttcaatgaccggatagctctttaaacacttggttccagtcatt

SEQ ID NO: 3510 - DNA, 50 bp, Artificial
  Synthetic
aacaagaccataatcgcaccagcataaacaatgatttcgagggcgccggc

SEQ ID NO: 3511 - DNA, 50 bp, Artificial
  Synthetic
gaagagacctgaataacgtcaccacgaactcgaccatcacgtgtccacgg

SEQ ID NO: 3512 - DNA, 50 bp, Artificial
  Synthetic
aaccagcgaaaacatatatatgcaaaaatggcttggacgagcaaagcagg

SEQ ID NO: 3513 - DNA, 50 bp, Artificial
  Synthetic
tcgtcaggtaactgcagaatattttcatcagtcatctgatctttttgttc

SEQ ID NO: 3514 - DNA, 50 bp, Artificial
  Synthetic
acttcaggaatctcaactaagtctctagccacctgatcaaatacatcgcc

SEQ ID NO: 3515 - DNA, 50 bp, Artificial
  Synthetic
atttcaccttgagtggttacttcaataatcgaatagctacgttgttggta

SEQ ID NO: 3516 - DNA, 50 bp, Artificial
  Synthetic
gccccgcctcgttggcgagaatgatgccgacattcgggcgaaaaccatcg

SEQ ID NO: 3517 - DNA, 50 bp, Artificial
  Synthetic
gctgaacgcggtctgggtcgggatgcccgccggaccggccttgaagaagg

SEQ ID NO: 3518 - DNA, 50 bp, Artificial
  Synthetic
gtagagcagcgacaggcgcgacggttcgtcgtagcgcgaacggatacgct

SEQ ID NO: 3519 - DNA, 50 bp, Artificial
  Synthetic
gaagaccagcacctgttcccaggcgccgacggttaccaggtgcgccagca

SEQ ID NO: 3520 - DNA, 50 bp, Artificial
  Synthetic
cgcctcggccagccggttgtacgggtagtgcgaggaactggcgcgctcgt

SEQ ID NO: 3521 - DNA, 50 bp, Artificial
  Synthetic
tgcaggtcgtggttgcccaggacgctgaccaccgactcgcgcatggcata

SEQ ID NO: 3522 - DNA, 50 bp, Artificial
  Synthetic
ccagggctgcatgcgccagaggtcgccgcgggtatcgggatcgtcggcga

SEQ ID NO: 3523 - DNA, 50 bp, Artificial
  Synthetic
caacggcgtcatccagcttgccgctgtcgaccgcgaccttggccacgaac

SEQ ID NO: 3524 - DNA, 50 bp, Artificial
  Synthetic
cgagctgtagtagtcgagcaggctaagggccttttccgggtcctgccgcg

SEQ ID NO: 3525 - DNA, 50 bp, Artificial
  Synthetic
cgtagatcggacgcttgaaggtgtcggggctgaccacttcgacgatctcg

SEQ ID NO: 3526 - DNA, 50 bp, Artificial
  Synthetic
gccaccaggacattggccccggtcacttcgcgcttgccggaactctgcac

SEQ ID NO: 3527 - DNA, 50 bp, Artificial
  Synthetic
aacagttcgctgggatgctgggtgcggctggcgccgttgccgcagcccat

SEQ ID NO: 3528 - DNA, 50 bp, Artificial
  Synthetic
acaggcgctgggccatcacggtgcagaggttctccagttcctcggcggtc

SEQ ID NO: 3529 - DNA, 50 bp, Artificial
  Synthetic
tgaagcccaggctgttctccagcccggcgccttcgtgggcggcggccatg

SEQ ID NO: 3530 - DNA, 50 bp, Artificial
  Synthetic
ggcgcggccgccagcacttcggcattcagcaatgcatccacgcgaggagc

SEQ ID NO: 3531 - DNA, 50 bp, Artificial
  Synthetic
aacttgtccttgaattccagttcctgcttcaggctgctgtcgcttttcag

SEQ ID NO: 3532 - DNA, 50 bp, Artificial
  Synthetic
ggatgccgttgccgctgagcgtgcggatcgcccgcagtcgcgccgagggc

SEQ ID NO: 3533 - DNA, 50 bp, Artificial
  Synthetic
gtcgaggatgatattgccgttgtcggtcagcacgccttcgcggtagaccg

SEQ ID NO: 3534 - DNA, 50 bp, Artificial
  Synthetic
ctgcgggtatttcttgtgcaggatctcggtcaggtcaccgccgtcgtcca

SEQ ID NO: 3535 - DNA, 50 bp, Artificial
  Synthetic
gaactgatcggcggcctgtacagtcaatgctgcgaccggctgcagagcca

SEQ ID NO: 3536 - DNA, 50 bp, Artificial
  Synthetic
cttgaggcgagcggcgaagctgtcgggcgggatctgggtgctcttgtcca

SEQ ID NO: 3537 - DNA, 50 bp, Artificial
  Synthetic
ccgtcgaggcgagccaggaccagttcgttggcgtgatcggcaaggtcagc

SEQ ID NO: 3538 - DNA, 50 bp, Artificial
  Synthetic
tcgacctccgccacacggtcgaggatcacccggctgccacggtggccgcg

SEQ ID NO: 3539 - DNA, 50 bp, Artificial
  Synthetic
gcggcgagcaggatcagtacccagagcggcatttccgtcagtgtctgcgg

SEQ ID NO: 3540 - DNA, 50 bp, Artificial
  Synthetic
agcaaggcgccggccagcaggaccagcaacacggccggcaggagcagagc

SEQ ID NO: 3541 - DNA, 50 bp, Artificial
  Synthetic
gccggcggcgaggtcctgctcgttggcgtgggacaactccgcgcgggcgg

SEQ ID NO: 3542 - DNA, 50 bp, Artificial
  Synthetic
cgtcgcgggtctcggcgtcgcagtcgcggtcgtgctcggcgaccgccatc

SEQ ID NO: 3543 - DNA, 50 bp, Artificial
  Synthetic
ggtggcgaggaacgcggcgaccgacatgtgcagcaggcggtaggggaacg

SEQ ID NO: 3544 - DNA, 50 bp, Artificial
  Synthetic
gtccgcgccaggtcgccggggccgtagaaatagtcgtccggccagcggtg

SEQ ID NO: 3545 - DNA, 50 bp, Artificial
  Synthetic
agagcgccgagatcagtaccgcggtgagggcgaaggtgccgccgtggggc

SEQ ID NO: 3546 - DNA, 50 bp, Artificial
  Synthetic
cgccaggaacaggctcagccaggccaccaggatcgccaccagcagcgccg

SEQ ID NO: 3547 - DNA, 50 bp, Artificial
  Synthetic
gcaggaaatcgagcacgcggatcatctcttccttcggctcgcccaccgac

SEQ ID NO: 3548 - DNA, 50 bp, Artificial
  Synthetic
gaaatcgtcggcgaccttggtcaccttgccggcgataccgccggaagtga

SEQ ID NO: 3549 - DNA, 50 bp, Artificial
  Synthetic
ggcgtgctccaggcggcccttgtacttgcaggcgatgctcacggcgaagt

SEQ ID NO: 3550 - DNA, 50 bp, Artificial
  Synthetic
cgtccttgggcaggacttcggaataaccggggatcagaaggacgtcgtcg

SEQ ID NO: 3551 - DNA, 50 bp, Artificial
  Synthetic
ggcaacgtcgctccatttccgggttgtcgcgctgcaccgaggcgaagtcg

SEQ ID NO: 3552 - DNA, 50 bp, Artificial
  Synthetic
ggccatgcgcacttcgcgcagagtgtccttgatgttgtcctcggtcagct

SEQ ID NO: 3553 - DNA, 50 bp, Artificial
  Synthetic
cgatgcgctcgacgaagcgaccatcgcgcgcattgcggctgttggtcacg

SEQ ID NO: 3554 - DNA, 50 bp, Artificial
  Synthetic
ggcaactcgctacgcgggatgcagatctcgtaaccggtgaaggtgcgggc

SEQ ID NO: 3555 - DNA, 50 bp, Artificial
  Synthetic
catcgaccagcaccatggccggcaactcaccgccggacaggacataatcg

SEQ ID NO: 3556 - DNA, 50 bp, Artificial
  Synthetic
ataccgccttggtcacacgggtttcggaaagctcggtgcgacgcaggatt

SEQ ID NO: 3557 - DNA, 50 bp, Artificial
  Synthetic
cgcaccagcatgtcggtgatttccagggcctgctcgccggtgtccggctg

SEQ ID NO: 3558 - DNA, 50 bp, Artificial
  Synthetic
tttcgagatagcgggattcgtcgagcagaccttcctcggccaggcggtcg

SEQ ID NO: 3559 - DNA, 50 bp, Artificial
  Synthetic
ggtgaagtgggagtcgatggaaacgccgatcacctcgacgttgcgcgcct

SEQ ID NO: 3560 - DNA, 50 bp, Artificial
  Synthetic
cttcgcgggtgacctggccgccgttgttgcggatgtcgtcgcaggcctgg

SEQ ID NO: 3561 - DNA, 50 bp, Artificial
  Synthetic
ggctgccgcgcaggcgatagacctcggtgccggccacgcggtagcggctg

SEQ ID NO: 3562 - DNA, 50 bp, Artificial
  Synthetic
ctccagcatcttgtcgtaacgatcggcttcagccttgtccatgaacaaac

SEQ ID NO: 3563 - DNA, 50 bp, Artificial
  Synthetic
cctcctcctggggcagcaggcgctgatccagcaaccgcagcgtaccgtcc

SEQ ID NO: 3564 - DNA, 50 bp, Artificial
  Synthetic
gcttccttgacgaagccgcgactcagactgatcaggctggaaacgacgat

SEQ ID NO: 3565 - DNA, 50 bp, Artificial
  Synthetic
accgcgtagccgccgacgcaacggtcgtgcacgcaggaaaccgcggcgaa

SEQ ID NO: 3566 - DNA, 50 bp, Artificial
  Synthetic
gtcggcgcgaggattgaagaaggcgggattgatacggcaggattcctcga

SEQ ID NO: 3567 - DNA, 50 bp, Artificial
  Synthetic
cgtcttcgacgacgaatccagccgggtgctgacatacttcggggtcatgg

SEQ ID NO: 3568 - DNA, 50 bp, Artificial
  Synthetic
tccacggacagagcattggactcgagcgcatcgtgggaacgacgcatgtc

SEQ ID NO: 3569 - DNA, 50 bp, Artificial
  Synthetic
caggccatgtcggcgcgattgtccagcaccaggtggcggtcgacgcgcag

SEQ ID NO: 3570 - DNA, 50 bp, Artificial
  Synthetic
accatcaggtggacctgctcgatgcgcgccacggtctgggtcttggcggc

SEQ ID NO: 3571 - DNA, 50 bp, Artificial
  Synthetic
gcggcggcacctcgcggttttccttgggcgagagcccttcgaggatggcg

SEQ ID NO: 3572 - DNA, 50 bp, Artificial
  Synthetic
ggccatggcggtgctggaaagagcggcaacgccggcggcgatcagtagtg

SEQ ID NO: 3573 - DNA, 50 bp, Artificial
  Synthetic
acggaatccgctttccccgaggatccgcaccacctcggcggcgaaatcgg

SEQ ID NO: 3574 - DNA, 50 bp, Artificial
  Synthetic
ctttgacctgcgcctgcttctggttcttcttggcgaccgcagcctgcttc

SEQ ID NO: 3575 - DNA, 50 bp, Artificial
  Synthetic
caccgcatgtccgaagacgatcgggtgggaaatcttcatcatggtcgcct

SEQ ID NO: 3576 - DNA, 50 bp, Artificial
  Synthetic
accgggcgctggcagacgtagagatcgagttgctggcgcagggccacgtt

SEQ ID NO: 3577 - DNA, 50 bp, Artificial
  Synthetic
tgcgcggtgacgacgtgcccattttccaactccacacggaacatggtgtt

SEQ ID NO: 3578 - DNA, 50 bp, Artificial
  Synthetic
tggaatcccgtttgcacgtccaccgtttcggaagcgccttgcagtgaagt

SEQ ID NO: 3579 - DNA, 50 bp, Artificial
  Synthetic
gcgaacacgacaaagaagatggcgccgccgaagcctcccagcaaggcgtt

SEQ ID NO: 3580 - DNA, 50 bp, Artificial
  Synthetic
tcccaagcatcatctgatgtaataaatcgctctcttaactctggcttttt

SEQ ID NO: 3581 - DNA, 50 bp, Artificial
  Synthetic
cccataggtgtaataggtgaaaccaactgttctctattaccacacgtttg

SEQ ID NO: 3582 - DNA, 50 bp, Artificial
  Synthetic
gcttcgctatccaatcttgggaaaataggtttaggttgcccagtaaccat

SEQ ID NO: 3583 - DNA, 50 bp, Artificial
  Synthetic
ttctataatctgttgcattattagcttcagtgccagctacccaaaagcca

SEQ ID NO: 3584 - DNA, 50 bp, Artificial
  Synthetic
ctgatccaaagatagcatgttgctcactcatatcacttgttacaactgta

SEQ ID NO: 3585 - DNA, 50 bp, Artificial
  Synthetic
ataagtgcttgcgggataggatcaacatagctttttacgttcgcttcata

SEQ ID NO: 3586 - DNA, 50 bp, Artificial
  Synthetic
gaattgtattgaaaccacccacaccttttgcacttaatgtacggattgga

SEQ ID NO: 3587 - DNA, 50 bp, Artificial
  Synthetic
gtctcttggtaaccacaatagtgacattttaataagtctgtcgttttatg

SEQ ID NO: 3588 - DNA, 50 bp, Artificial
  Synthetic
agcacctaatgctgtttcaattgcctgagttaatttagatggcacatcaa

SEQ ID NO: 3589 - DNA, 50 bp, Artificial
  Synthetic
gcgcattttgtttcccgtaattttgaaagtttactgcttgtttttgatgc

SEQ ID NO: 3590 - DNA, 50 bp, Artificial
  Synthetic
atgcatgagctgatctaatatagtttccgctaaatataattgttgcggtc

SEQ ID NO: 3591 - DNA, 50 bp, Artificial
  Synthetic
ttcatcttcattaatttcatcgtataagcgaatcgcatcactatagttac

SEQ ID NO: 3592 - DNA, 50 bp, Artificial
  Synthetic
gaaaatgaagttacctggagtgatttcattacggaatgatttaccaattt

SEQ ID NO: 3593 - DNA, 50 bp, Artificial
  Synthetic
ctacaatttggtttacggcattatatcctcgttcatctaatgttcgataa

SEQ ID NO: 3594 - DNA, 50 bp, Artificial
  Synthetic
gcatattcatataatggatggtcattaataataattcctgccgcatgtgt

SEQ ID NO: 3595 - DNA, 50 bp, Artificial
  Synthetic
actcctgacgcattcggatgaccaccgccaccaaaatcttgcgcaatatc

SEQ ID NO: 3596 - DNA, 50 bp, Artificial
  Synthetic
gtttcaggtaacaacaatggtagctcttcttcaggaacagttgtcattgt

SEQ ID NO: 3597 - DNA, 50 bp, Artificial
  Synthetic
catcttaagcgtaaaccaacatatggaaaaattaatgcactgactccaaa

SEQ ID NO: 3598 - DNA, 50 bp, Artificial
  Synthetic
attctgttggtgaatatgtttttttgtaataggacgttcttcgctatagt

SEQ ID NO: 3599 - DNA, 50 bp, Artificial
  Synthetic
aaacttaaaatagacataataactactggcgtcgctgcggaaatattaaa

SEQ ID NO: 3600 - DNA, 50 bp, Artificial
  Synthetic
acggcaattactttagggtttacatgtctcaagtaagcttgtgccaattg

SEQ ID NO: 3601 - DNA, 50 bp, Artificial
  Synthetic
accgactaagagtaataagacgataaatacccaccaattctcttttggaa

SEQ ID NO: 3602 - DNA, 50 bp, Artificial
  Synthetic
agtgttaacgtgacaggtctaactttgtacttttcaccattaaccttaat

SEQ ID NO: 3603 - DNA, 50 bp, Artificial
  Synthetic
tagaaaatgagtagggcacgcatgccataataactaaacctttcccagaa

SEQ ID NO: 3604 - DNA, 50 bp, Artificial
  Synthetic
ggtagtccaacatctaagccactcgcttcgatttgagtcgttggatattt

SEQ ID NO: 3605 - DNA, 50 bp, Artificial
  Synthetic
caatacgatttgaaacaccgattactgtacattctttagttaaattagcg

SEQ ID NO: 3606 - DNA, 50 bp, Artificial
  Synthetic
atcctcgttctggaatgtcgagttgtgggcttgaaacacccaagtcgtaa

SEQ ID NO: 3607 - DNA, 50 bp, Artificial
  Synthetic
catcccctgtttcttagccttttcgtatatgcgttcataagaagaattct

SEQ ID NO: 3608 - DNA, 50 bp, Artificial
  Synthetic
tactgtagctatgactgccaatacatcaatggcaccacctaaaggtccac

SEQ ID NO: 3609 - DNA, 50 bp, Artificial
  Synthetic
aaaatgaccaccgccattattacggactgacatcctcatcgcttccggta

SEQ ID NO: 3610 - DNA, 50 bp, Artificial
  Synthetic
ccaccacgtttactttcgatttcataaccatgttcattagtgaatcgtgt

SEQ ID NO: 3611 - DNA, 50 bp, Artificial
  Synthetic
cataacaattagcacacccaaatttaccaacatgtgcaatatctttcaaa

SEQ ID NO: 3612 - DNA, 50 bp, Artificial
  Synthetic
aaaacacggtcttgtgtttctaattgattataagtgtctaacttttgtcg

SEQ ID NO: 3613 - DNA, 50 bp, Artificial
  Synthetic
aacttcattaataaagggacattatactcttctgatatcgtgcgacccgc

SEQ ID NO: 3614 - DNA, 50 bp, Artificial
  Synthetic
aattgaatttaagctgtcatccacttctaataagaaacatgacactagct

SEQ ID NO: 3615 - DNA, 50 bp, Artificial
  Synthetic
gagatatattttgtctccaaaacatattcgtcatatcttcttgtgtgttc

SEQ ID NO: 3616 - DNA, 50 bp, Artificial
  Synthetic
actcgaacacttactactaaatctttatattcttcaggattacctaaacc

SEQ ID NO: 3617 - DNA, 50 bp, Artificial
  Synthetic
cacctgataacgttgtagcttgttgacctaatgtgacgtatccaagacca

SEQ ID NO: 3618 - DNA, 50 bp, Artificial
  Synthetic
ttgtaatctctgtttgctcgcattgtcagattcatttttaagtgcgcttt

SEQ ID NO: 3619 - DNA, 50 bp, Artificial
  Synthetic
actatagaattttaatgcacgtccacctggtgtagtctctggattaccga

SEQ ID NO: 3620 - DNA, 50 bp, Artificial
  Synthetic
atatgaatatgtcgctattatgtgtcgatgttaagtgttcaggtaatgga

SEQ ID NO: 3621 - DNA, 50 bp, Artificial
  Synthetic
ttgttcttaatttgatggtcagtcatttcgtacacttgttccgagtgagc

SEQ ID NO: 3622 - DNA, 50 bp, Artificial
  Synthetic
ccttgaacagtcagatgactaattaaaatattgacggcatcttcatcaat

SEQ ID NO: 3623 - DNA, 50 bp, Artificial
  Synthetic
tctctttgttcagttgatgctttaccaaacaaggcataagtcattgcatc

SEQ ID NO: 3624 - DNA, 50 bp, Artificial
  Synthetic
aaggcaaaatgtatcgttcttgccactttttttcttgctcgaactctgct

SEQ ID NO: 3625 - DNA, 50 bp, Artificial
  Synthetic
gagcagtaatacagcgttgtacttcatcatttttgcctggcactgttatt

SEQ ID NO: 3626 - DNA, 50 bp, Artificial
  Synthetic
ataatagtgttgcacctaaagctgtagtaccaacaaattgccattttttc

SEQ ID NO: 3627 - DNA, 50 bp, Artificial
  Synthetic
ataccttcgtcgtcgtaatcatatatatctggcgctgctgcaccgcatgc

SEQ ID NO: 3628 - DNA, 50 bp, Artificial
  Synthetic
atcaacataatcctcaacaattgcgtttaatatactcaattgcctatctg

SEQ ID NO: 3629 - DNA, 50 bp, Artificial
  Synthetic
ataaaatttaacttctacaggttgggcatattgtagcgcctcgtgtagcc

SEQ ID NO: 3630 - DNA, 50 bp, Artificial
  Synthetic
tgccatgtttttaaaatcgttattgattgcatcttttgcatttccccaca

SEQ ID NO: 3631 - DNA, 50 bp, Artificial
  Synthetic
gtatcataccaaagcatatcattgactggattttctggcggtgtatcact

SEQ ID NO: 3632 - DNA, 50 bp, Artificial
  Synthetic
gttgctttatatccttcgccaagattggatatcacaaagtcaccgccgac

SEQ ID NO: 3633 - DNA, 50 bp, Artificial
  Synthetic
tcatttacattcaagtttttaagcatatctttgaactctggagtgccttt

SEQ ID NO: 3634 - DNA, 50 bp, Artificial
  Synthetic
gcttcgtgacctgcatttcctgctacgattcctaaacctactgctaatga

SEQ ID NO: 3635 - DNA, 50 bp, Artificial
  Synthetic
tgatttactgtgaatccagcaccttgtgcagcagcagcccaattattagc

SEQ ID NO: 3636 - DNA, 50 bp, Artificial
  Synthetic
tctttaccaattgttagaccaccagtagagtgatctgctgttgcaacgac

SEQ ID NO: 3637 - DNA, 50 bp, Artificial
  Synthetic
taaagccattcaggatgaatgccactattaagtatctcttggaattcttg

SEQ ID NO: 3638 - DNA, 50 bp, Artificial
  Synthetic
ttataatttcataaactggtgcgccttcatggtgatactgtcgataaata

SEQ ID NO: 3639 - DNA, 50 bp, Artificial; identical to SEQ ID NO: 2767
  Synthetic

SEQ ID NO: 3640 - DNA, 50 bp, Artificial; identical to SEQ ID NO: 2768
  Synthetic

SEQ ID NO: 3641 - DNA, 50 bp, Artificial; identical to SEQ ID NO: 2769
  Synthetic

SEQ ID NO: 3642 - DNA, 50 bp, Artificial; identical to SEQ ID NO: 2771
  Synthetic

SEQ ID NO: 3643 - DNA, 50 bp, Artificial; identical to SEQ ID NO: 2773
  Synthetic

SEQ ID NO: 3644 - DNA, 50 bp, Artificial; identical to SEQ ID NO: 2775
  Synthetic

SEQ ID NO: 3645 - DNA, 50 bp, Artificial; identical to SEQ ID NO: 2776
  Synthetic

SEQ ID NO: 3646 - DNA, 50 bp, Artificial; identical to SEQ ID NO: 2777
  Synthetic

SEQ ID NO: 3647 - DNA, 50 bp, Artificial; identical to SEQ ID NO: 2770
  Synthetic

SEQ ID NO: 3648 - DNA, 50 bp, Artificial; identical to SEQ ID NO: 2779
  Synthetic

What is claimed is:

1. A method, comprising:

obtaining a sample including one or more bacterial cells, wherein the sample is obtained from a patient;

processing the sample to enrich the one or more bacterial cells;

contacting the sample with one or more antibiotic compounds;

lysing the sample to release messenger ribonucleic acid (mRNA) from the one or more bacterial cells;

hybridizing the released mRNA to at least one set of two nucleic acid probes, wherein each nucleic acid probe includes a unique barcode or tag and wherein the at least one set of nucleic acid probes includes one or more probes from SEQ ID NOs: 74-86 and one or more probes from SEQ ID NOs: 91-103;

detecting the hybridized nucleic acid probes;

identifying one or more genetic resistance determinants;

determining antibiotic susceptibility of the one or more bacterial cells using a machine learning algorithm trained on a susceptibility classification dataset, wherein the machine learning algorithm generates a ranked list of two or more susceptibility features, thereby determining antibiotic susceptibility of the one or more bacterial cells; and selecting an appropriate antibiotic based on the determined antibiotic susceptibility of the one or more bacterial cells; and administering the appropriate antibiotic to the patient.

2. The method of claim 1, wherein the hybridizing occurs at a temperature between about 64° C. and about 69° C.

3. The method of claim 1, wherein the hybridizing occurs at a temperature between about 65° C. and about 67° C.

4. The method of claim 1, wherein the hybridizing occurs at about 65° C. or about 66° C. or about 67° C.

5. The method of claim 1, wherein the at least one set of two nucleic acid probes is selected from the group consisting of: SEQ ID NO: 74 and SEQ ID NO: 91; SEQ ID NO: 75 and SEQ ID NO: 92; SEQ ID NO: 76 and SEQ ID NO: 93; SEQ ID NO: 77 and SEQ ID NO: 94; SEQ ID NO: 78 and SEQ ID NO: 95; SEQ ID NO: 79 and SEQ ID NO: 96; SEQ ID NO: 80 and SEQ ID NO: 97; SEQ ID NO: 81 and SEQ ID NO: 98; SEQ ID NO: 82 and SEQ ID NO: 99; SEQ ID NO: 83 and SEQ ID NO: 100; SEQ ID NO: 84 and SEQ ID NO: 101; SEQ ID NO: 85 and SEQ ID NO: 102; and SEQ ID NO: 86 and SEQ ID NO: 103.

6. The method of claim 5, wherein the at least one set of two nucleic acid probes is selected from the group consisting of: SEQ ID NO: 74 and SEQ ID NO: 91; SEQ ID NO: 75 and SEQ ID NO: 92; SEQ ID NO: 76 and SEQ ID NO: 93; SEQ ID NO: 77 and SEQ ID NO: 94; SEQ ID NO: 78 and SEQ ID NO: 95; SEQ ID NO: 80 and SEQ ID NO: 97; SEQ ID NO: 82 and SEQ ID NO: 99; SEQ ID NO: 83 and SEQ ID NO: 100; and SEQ ID NO: 85 and SEQ ID NO: 102.

7. The method of claim 1, wherein at least two sets of nucleic acid probes are selected.

8. The method of claim 1, wherein at least three sets of nucleic acid probes are selected.

9. The method of claim 1, wherein at least four sets of nucleic acid probes are selected.

10. A method, comprising:

obtaining a sample including one or more bacterial cells, wherein the sample is obtained from a patient;

processing the sample to enrich the one or more bacterial cells;

contacting the sample with one or more antibiotic compounds;

lysing the sample to release messenger ribonucleic acid (mRNA) from the one or more bacterial cells;

hybridizing the released mRNA to at least five nucleic acid probe sets, wherein each nucleic acid probe includes a unique barcode or tag and wherein the at least one set of nucleic acid probes includes one or more probes from SEQ ID NOs: 74-86 and one or more probes from SEQ ID NOs: 91-103;

detecting the hybridized nucleic acid probes;

identifying one or more genetic resistance determinants;

determining antibiotic susceptibility of the one or more bacterial cells using a machine learning algorithm trained on a susceptibility classification dataset, wherein the machine learning algorithm generates a ranked list of two or more susceptibility features, thereby determining antibiotic susceptibility of the one or more bacterial cells; and selecting an appropriate antibiotic based on the determined antibiotic susceptibility of the one or more bacterial cells and administering the appropriate antibiotic to the patient.

11. The method of claim 10, wherein the at least five nucleic acid probe sets comprise: SEQ ID NO: 74 and SEQ ID NO: 91; SEQ ID NO: 75 and SEQ ID NO: 92; SEQ ID NO: 76 and SEQ ID NO: 93; SEQ ID NO: 78 and SEQ ID NO: 95; and SEQ ID NO: 84 and SEQ ID NO: 101.

* * * * *